United States Patent 11,141,474 (ARTIFICIAL NUCLEIC ACID MOLECULES ENCODING A NOROVIRUS ANTIGEN AND USES THEREOF) - sequence listing, part 13

SEQ ID NO: 28701 - RNA, 1623 nt, Artificial Sequence
  derived and/or modified sequence opt5 from major_capsid_protein__Norovirus__AKE31858
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauaucuccggcagcagaaauuacaccaugaaccucgccucccagaauuggaacucuuaugaucccaccgaggaaaucccugcuccccugggcacaccggacuucgucgggaaaacgcagggagugcuuacccagacaaccaagacaaauggcagcacccgggggcacaaggcgacgguuuacacaggauccgccgacuuuagcccuaaacugggccgcgugcaauucgcuaccgauaccgacaacgauuuugagacaaaucagaacaccaaguucacacccgucggggugauucaggacggaucuacgacccccagagaugaaccucaacaguggguucucccguccuacagcggccggaauacacauaacgugcaccuggcccccgccgucgcuccuaccuuucccggcgagcagcuucuguucuuucgcucuacaaugccuggguguagcggauaucccaauauggaccucgauagacugcugccucaggaaugggugcaauacuucuaucaggagcccgccccggcgcaguccgacguggcucuccugcgguuuguuaacccugauaccggcagaguccuuuucgagugcaaacugcacaagucuggguacgugacgguggcccauaccggacagcacgaccucgucauucccccuaauggcuauuuucgcuucgauagcugggugaaccaauucuacacacuggcccccauggggaacggcaccggacggagacgcgcucuuuga

SEQ ID NO: 28702 - RNA, 1623 nt, Artificial Sequence
  derived and/or modified sequence opt5 from major_capsid_protein__Norovirus__AKE31861
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcucgccuguauacaccccuuagagccaauaacgcuggcgaugacguuuucaccgugagcugccgggugcugacacgcccuucuccggauuuugacuucauuuuucucgugcccccuaccgucgaauccagaacgaaacccuucagcguuccugugcugaccgucgaggaaaugacaaacucucgguuucccaucccgcuugagaagcuguucaccgggccuuccagcgccuucgugguucagccccagaauggacgcuguacaaccgauggcgugcuccuggggacgacacaacugucuccugucaacauuugcaccuuuagaggagacgugacacauaucuccggcagccggaauuacaccaugaaccucgccucccagaauuggaacucuuaugaucccaccgaggaaaucccugcuccccugggcacaccggacuucgucgggaaaauucagggagugcuuacgcagaccacaaagaccaauggcagcacacgcgggcacaaggcgaccguuuacacgggauccgccgacuuuagcccuaaacugggcagagugcaauucgcuacagauaccgacaacgauuuugagaccaaucagaacacaaaguucacccccgucggggugauccaggacggaucuacaacgccccggaaugaaccucaacaguggguucucccguccuacagcggccgcaacacccauaaugugcaccuggcccccgccgucgcuccuacauuucccggcgagcagcuucuguucuuuagaucuaccaugccuggguguagcggauaucccaacauggaucucgacugccugcugccucaggaaugggugcaauacuucuaucaggaggccgcgcccgcucaguccgauguggcccuccugcgguuuguuaauccggacacaggcagaguccuuuucgaguguaaacugcacaagucuggguacgugaccguggcccauacgggacagcacgaucucgucauuccucccaacggcuauuuucgcuucgacagcugggugaaccaauuccauacccuggcuccuauggggaauggcacaggacggagacgcgcccuuuga

SEQ ID NO: 28703 - RNA, 1623 nt, Artificial Sequence
  derived and/or modified sequence opt5 from major_capsid_protein__Norovirus__AKE31864
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauucgcaccuuuagaggagacgugacacauauccccggcucucggaacuacaccaugaacuccgccagccagaauuggaacuccuaugauccuaccgaggaaauccccgcuccgcucggcacaccugacuucgucgggaaaauucagggagugcugacgcagaccacacgcgcgaauggcucuaccagagggcacaaggccacaguuuacaccggaagcgcugacuuuucccccaaacuuggccgggugcaauucgccacggauacagacaaugauuuugagaccaaccagaauaccaaguucacacccgucggggugauccaggacggaagcaccacaccucgcaacgaaccgcaacaguggguucugcccucuuacuccggcagaaauauucauaacgugcaccucgccccugcugucgcccccacguuuccuggcgagcagcugcuuuucuuucggagcaccaugcccgggugcucuggauauccuaauauggaucuggacugucuccugccccaggaaugggugcaauacuucuaucaggaggcggcuccggcccagagcgauguggcccugcucagauuuguuaacccugacacaggccgcguccuguucgagugcaaacuucacaaguccggguacgugaccguggcucauacaggacagcacgaucuggucauucccccuaacggcuauuuucgguucgacucuugggugaaucaauucuacacccucgcccccauggggaacggcacgggaagacgccgggcucuguga

SEQ ID NO: 28704 - RNA, 1623 nt, Artificial Sequence
  derived and/or modified sequence opt5 from major_capsid_protein__Norovirus__AKE31867
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugagcaucccccugccugauguccggaacaauuuuuaucacuacaaccaguccaaugaccccaccauuaagcugaucgcuaugcucuauacaccccugcgcgccaacaacgcuggcgaugacguuuucaccgugagcugcagagugcuuacacggccuucuccggauuuugacuucauuuuucuggugcccccuaccgucgaaucccgcacgaaacccuucagcguuccugugcucaccgucgaggaaaugacaaauucuagauuucccaucccgcuggagaaacuuuucaccgggccuuccagcgccuucgugguucagccccagaacggacgguguacaaccgauggcgugcugcucgggacgacacaacugucuccugucaauauuugcaccuuucgcggagacgugacacauauccccggcuccagaaacuacaccaugaaucuggccagccagaacuggaacuccuaugauccuaccgaggaaauccccgcuccgcucggcacaccugacuucgucgggaagauucagggagugcugacgcagaccacacgggcgaauggcucuacccgcgggcacaaggccacaguuuacaccggaagcgcugacuuuucccccaaacuuggcagagugcaauucgccacggauacagacaaugauuuugagaccaaccagaauaccaaguucacacccgucggggugauccaggacggaagcaccacaccucggaacgaaccgcaacaguggguucugcccucuuacuccggccgcaauauucauaacgugcaccucgccccugcugucgcccccacguuuccuggcgagcagcugcuuuucuuuagaagcaccaugcccggguguucuggauauccuaauauggaucuggacugccuccugccccaggaaugggugcaauacuucuaucaggaggcggcuccggcccagagcgauguggcccugcuccgguuuguuaacccugacacaggcagaguccuguucgaguguaaacuucacaaguccggguacgugaccguggcucauacaggacagcacgaucuggucauucccccuaacggcuauuuucgcuucgacucuugggugaaucaauucuacacccucgcccccauggggaacggcacgggacggagacgcgcucuguga

SEQ ID NO: 28705 - RNA, 1623 nt, Artificial Sequence
  derived and/or modified sequence opt5 from major_capsid_protein__Norovirus__AKE31870
augaagauggccagcuccgacgcuaaccccucugauggcagcaccgccaaucuggugccugaggucaacaaugaaguuauggcgcucgagccgguggugggggcuuccaucgccgcccccgucgcuggacagcaaaacgugauugacccuuggaucagaaauaacuucguucaggcccccggcggggaauuuacagugucuccucggaaugcucccggagagauucuguggagcgccccucuuggcccggaucugaaccccuaccucccucaccuggcgcgcauguauaauggguacgccggaggcuucgaaguccaggugauccuugcuggcaacgccuuuacggcugggaaaauuaucuucgccgcgguucccccuaauuuucccaccgagggacuguccccgucucaggugacaauguucccucauaucauugucgacgugagacaacucgagcccgugcugaucccucugcccgauguccggaacaauuuuuaucacuacuaucagagcaacgaccccaccauuaagcucaucgccaugcuguacacaccucuucgcgcuaauaacgccggcgaugacguuuucaccguguccugcagagugcugacacggccgagccccgauuuugacuucauuuuucucgucccucccaccguggaaucucgcacgaaaccuuucuccguucccgugcugaccgucgaggaaaugacaaacagcagauuuccgaucccucuugagaagcuguucaccgggcccucuuccgcuuucgugguucagccucagaauggacgguguacaaccgauggcgugcuccuggggacgacacaacugagccccgucaacauuugcaccuuucgcggagacgugacacauaucucuggcuccagaaauuauaccaugaaccucgccagccagaauuggaacuccuacgauccuaccgaggaaauccccgccccgcugggcacaccugacuucgucgggaaaauucagggagugcuuacgcagaccacacggaccaauggcucuacacgcgggcacaaggcuaccguuuacacgggaagcgcggacuuuucccccaagcugggcagagugcaauucgccacagauaccgacaacgauuuugagaccaaucagaacacaaaauucacccccgucggggugauccaggacggaagcacaacgccucggaaugaaucucaacaguggguucucccguccuauagcggccgcaacacccauaaugugcaccuggcucccgccgucgccccuacauuucccggcgagcagcuucuguucuuuagaucuaccaugccuggguguagcggauaccccaacauggaucucgacugccugcugccucaggaaugggugcaauauuucuaccaggaggcugcccccgcgcaguccgauguggcucuccugcgguuuguuaauccggacacaggcagaguccuuuucgaguguaagcugcacaaaucuggguaugugaccguggcccauacgggacagcacgaucucgucauuccucccaacggcuacuuucgcuucgacagcugggugaaccaauucuauacccuggccccuauggggaauggcacaggacggagacgcgcucuuuga

SEQ ID NO: 28706 - RNA, 1623 nt, Artificial Sequence
  derived and/or modified sequence opt5 from major_capsid_protein__Norovirus__AKE31873
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggaugcucccgucuuacuccggccgcaauacccauaacguucaccuggcccccgccguggcuccuacauuucccggcgagcagcuucuguucuuuagaagcaccaugccuggguguucuggauaucccaauauggaucucgacugccugcugccucaggaauggguccaauacuucuaucaggaggccgcgcccgcucagagcgauguggcccuccugcgguuugugaacccggacacaggcagaguucuuuucgaguguaagcugcacaaauccggguacgucaccguggcccauacgggacagcacgaucucgugauuccucccaacggcuauuuucgcuucgacucuugggucaaucaauucuacacccuggcuccuauggggaacggcacaggacggagacgcgcccuuuga

SEQ ID NO: 28707 - RNA, 1623 nt, Artificial Sequence
  derived and/or modified sequence opt5 from major_capsid_protein__Norovirus__AKE31876
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuagagaugacguuuucaccguguccugccgggugcugacacgcccuagcccggauuuugacuucauuuuucucgugcccccuaccgucgaaucuagaacgaaacccuucuccguuccugugcugaccgucgaggaaaugacaaauagccgguuucccaucccgcuugagaagcuguucaccggcccuucuuccgccuucgugguucagccccagaacgggcgcuguacaaccgauggagugcuccugggcacgacacaacugagcccugucaauauuugcaccuuuagaggggacgugacacauaucucuggaucccggaacuacaccaugaaucucgccagccagaacuggaacuccuaugaucccaccgaggaaaucccugcuccccugggcacaccggacuucgucggcaaaauucagggggugcuuacgcagaccacacgcaccgacggaucuacaagaggccacaaggcgaccguuuacacggggagcgccgauuuuuccccuaagcugggacgggugcaauucgcuacagacaccgauaaugacuuugagaccaaucagaacacaaaauucacccccgucggcgugauccaggaugggggaacaacgcaucgcaaugaaccccaacaguggguucucccuaacuacagcggcagaaauacccacaacgugcaccuggccccggccgucgcucccacauuuccuggcgagcagcuucuguucuuucggucuaccaugcccggguguuccggauauccuaauauggaccucgauugccugcugccccaggaaugggugcaauacuucuaucaggaggccgcgccugcucagagcgacguggcccuccugagauuuguuaaccccgauacaggccgcguccuuuucgaguguaagcugcauaaaucuggguacgugaccguggcccacacgggacagcaugaccucgucauuccgccuaacggcuauuuucgguucgauagcugggugaaucaauucuacacccuggcucccauggggaacggcacaggaagacgccgggcccuuuga

SEQ ID NO: 28708 - RNA, 1632 nt, Artificial Sequence
  derived and/or modified sequence opt5 from major_capsid_protein__Norovirus__AKF02368
augaagauggccagcaacgacgcugcccccuccaaugauggcgcggcugggcuggugccugagaucaacaaugaaaccauggcccucgagccggucgccggaggcgcuauugccgcuccccugacagggcagacgaacuucaucgacccuuggauuagaggaaauuacguucaagcccccaacggcgaauuuaccgugucuccucggaauagccccggggagauccuucugaaccucgaacugggaccugagcuuaauccguuccugucccaccucucucgcauguauaacggcuacgcgggcgggauugaugugcaggucaucauggccggaaaugcuuuuacagccggcaaaaucauuuucgcugccauucccccucauuuucccguggagaaccugagcccuccccagaucaccauguucccgcacaucauuguugacgugagaacacuggaaccuaucaauauucccgucccugaugugcggaacaacuuuuuccauuauaaucagaacaaugagucccgcaugagacucguugcgaugcuguacacaccccuucggucuaacgggagcgccgaagacguguuuaccgucuccugccgcgugcugaccaagcccagcgcugauuucgaguuuaauuaucucgugccuccgacggucgagucuagaaccaaacccuucacaaucccuauccugaccauuggagaaaugacaaacucccgguuucccguuccuaucgacaugcuucacaccagccccacggagaauauuguggugcaaccgcagaacggccgcuguacaaucgauggggaacugcucggaaccacacagcugauuaccucuaauaucugcuccuucagaggcagcaucucuggccaugaggggaacgacgaucagcaccuguggcacuucaauauuaccaacccuaauggaacacccuuugacccuacggaagauguccccgccccucucggcacccccgacuuccgggggcaacuguacggagugaucucccagcgcgacagagagggcacaccgagcgagaacaaucagaaggcuaaccggucccaugaagggguuauuucuaccaucagcccuaaauuugugcccaaacuuggauccgucaugauuggcacauggaccacggaugacaucaagaaucagcccagcaaguucacaccuaucggccugaacgaugacgauaacuuuaagcaaugggagcucccgaauuauucuggggcccugacccuuaacaugggacuggcccccuccguguucccuaccuaccccggcgaacagguucucuuuuuccgcagcuaccugccuaugaaagggggauauggcucucccuuuauugacugucuggugccucaggagugggucgcucacuucuaccaagaaagcgcgcccgcccagacagauguggcucucaucagauaugucaauccggagaccgggcgggugcuguuugaggccaaacuucauagacagggcuucauuacaguugccaaguccggagacucuccuaucaacgugcccgcuaauggcuacuuucgcuucgauagcugggucaaccaguucuauucccuggccccuauggggacgggaaauggccggagacgcauucaauga

SEQ ID NO: 28709 - RNA, 1644 nt, Artificial Sequence
  derived and/or modified sequence opt5 from major_capsid_protein__Norovirus__AKF42429
augaagauggccagcaacgacgcugcccccuccaaugauggcgcggcuaaccuggugccugaggccaccaaugaagucauggcccucgagccgguugugggggcuucuaucgccgcucccguggucggacagcaaaacauuaucgacccuuggauuagagaaaauuucgugcaggcgccccagggcgaguuuacaguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacggccggcaaaaucauuuuugcugccguucccccucauuuccccguggaaaauaucuccgcggcccagaucaccaugugcccucacgucauuguggaugugagacagcuggagcccguccugcucccgcugccugacauccggaaccgcuuuuuccauuauaaucaggaaaacacacccagaaugcggcuuguugcuaugcuguacaccccucuccgcgccaauucuggggaggauguguuuacagugagcuguagaguccugacccggcccgcucccgacuucgaguuuacauuccuugugccuccgaccguugaauccaagacgaaacccuuuacccugccuauucucacacugggagagcugagcaacucucgcuuccccgccccuaucgauaugcucuauaccgaccccaacgaagccauugugguccaaccgcagaauggcagaugcacacuggaugggacccuucagggaacgacacagcuggugccuacccaaaucuguuccuuucggggcacacucauuagccagaccucucgcuccgcugacagcaccgauucugcgcccagaguucggaaccacccucugcaugugcagcuuaagaaucuggacgggacacccuacgauccuacggacgagguccccgccgugcucggagcuaucgacuucaaaggcaccgucuucggcguggccucccaacgcaacacaaccgggaauagcaucggagccacaagagcucacgaaguucacauugauaccacgaacccgcgguauacaccuaagcugggcuccgugcugauguacucugagagcaccgacuuugaugacgggcagcccaccagauucacacccaucggaaugggcgccgaugacuggcaucagugggagcucccugaauacuccgggcaccugacccuuagcaugucucuggcgccggcugucgcccccgccuuuccuggagagcgcauucucuucuuucgguccgugguucccagcgcuggcggcuaugggucuggacauaucgauugccugauuccucaggaaugggugcaacacuucuaccaggaggccgcucccagccaguccgccgucgcgcuuaucagauaugugaauccugacacaggccgcaacaucuuugaagccaagcugcaccgggagggguucauuacgguggcuaauucuggaaacaaucccaucguugucccgccuaacggcuacuuuagauucgaggccugggugaaucaguuuuauacccucacacccauggggaccggccaaggacgccggagagugcaguga

SEQ ID NO: 28710 - RNA, 1644 nt, Artificial Sequence
  derived and/or modified sequence opt5 from major_capsid_protein__Norovirus__AKF42434
augaagauggccagcaacgacgcugcccccuccaaugauggcgcggcuaaccuggugccugaggccaccaaugaagucauggcccucgagccgguugugggggcuucuaucgccgcucccguggucggacagcaaaacauuaucgacccuuggauuagagaaaauuucgugcaggcgccccagggcgaguuuacaguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacggccggcaaaaucauuuuugcugccguucccccucauuuccccguggaaaauaucuccgcggcccagaucaccaugugcccucacgucauuguggaugugagacagcuggagcccguccugcucccgcugccugacauccggaaccgcuuuuuccauuauaaucaggaaaacacacccagaaugcggcuuguugcuaugcuguacaccccucuccgcgccaauucuggggaggauguguuuacagugagcuguagaguccugacccggcccgcucccgacuucgaguuuacauuccuugugccuccgaccguugaauccaagacgaaacccuuuacccugccuauucucacacugggagagcugagcaacucucgcuuccccgccccuaucgauaugcucuauaccgaccccaacgaagccauugugguccaaccgcagaauggcagaugcacacuggaugggacccuucagggaacgacacagcuggugccuacccaaaucuguuccuuucggggcacacucauuagccagaccucucgcuccgcugacagcaccgauucugcgcccagaguucggaaccacccucugcaugugcagcuuaagaaucuggacgggacacccuacgauccuacggacgagguccccgccgugcucggagcuaucgacuucaaaggcaccgucuucggcguggccucccaacgcaacacaaccgggaauagcaucggagccacaagagcucacgaaguucacauugauaccacgaacccgcgguauacaccuaagcugggcuccgugcugauguacucugagagcuccgacuuugaugacgggcagcccaccagauucacccccaucggaaugggcgccgaugacuggcaucagugggagcucccugaauacagcgggcaccugacacuuaauaugaaccuggcgccggcugucgcccccgccuuuccuggagagcgcauucucuucuuucggucugugguucccuccgcuggcggcuaugggagcggacauaucgauugccugauuccucaggaaugggugcaacacuucuaccaggaggccgcucccucucagagcgccgucgcgcuuaucagauaugugaauccugacaccggccgcaacaucuuugaagccaagcugcaccgggagggguucauuacaguggcuaauuccggaaacaaucccaucguugucccgccuaacggcuacuuuagauucgaggccugggugaaucaguuuuauacgcucacccccauggggacaggccaaggacgccggagagugcaguga

SEQ ID NO: 28711 - RNA, 1650 nt, Artificial Sequence
  derived and/or modified sequence opt5 from major_capsid_protein__Norovirus__AKF42437
augaagauggccagcaccgacgcugcccccuccaacgauggcgcggcuaaucuggugccugaggccaacaaugaagucauggcccucgagccgguugugggggcuucuaucgccgcucccguggucggacagcaaaacauuaucgacccuuggauuagagaaaauuucgugcaggcgccccagggcgaguuuacaguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacggccggcaaaaucauuuuugcugccguucccccucauuuccccgugaagaauaucuccgcggcccagaucaccaugugcccucacgucauuguggaugugagacagcuggaacccguccugcucccgcugccugacauccggaaccgcuuuuuccauuauaaucaggaggauacacccagaaugcggcuuguugcuaugcuguacaccccucuccgcgccaacucuggggaagacguguuuacagugagcuguagaguccugacccggcccgcucccgauuucgaguuuacauuccuugugccuccgaccguugaguccaaaacgaagcccuuuacccugccuauucucacacugggagaacugagcaauucucgcuuccccgccccuaucgacaugcucuauaccgaucccaacgagggcguggucgugcaaccgcagaacgggagaugcacacuggacggaacccuucagggcacgacacagcugguuccuacccaaauuugugccuuucgggggaaacucaucggacagacaucccgcagccccgauucugacuccaccgauagcgcuccuagacggcgcgaccacccccugcaugugcagcuugaaaaucuggacggcacccaauacgauccuacagacgagguccccgcgacgcucggcgccguggauuucaaggggaccauuuucggagucgcuucucagagagacacauccggcagccaggugggggccacccgggcccacgaaguucacaucaacacaaccgauccgagauauacgccuaagcugggauccauccugauguacucugagagccucgacuuugagacaggccagcccgugcgcuucacccccauugggaugggagaaaaugauuggcaucaaugggagcugccugacuacuccggccggcuuacccugaacaugaaucucgcuccggccgucgcgcccgcuuuuccuggcgaaagaauccuguucuuucgcagcauugugcccucugccgggggauauggcuccgggcagaucgauugccuuauuccucaggaguggguucagcacuucuaccaagaagccgcucccagccagucugccguggcucugauccgguaugucaacccugacacaggaagaaauaucuuugaggccaaacuccaucgcgagggcuucauuaccguggcgaacagcgggaauaaccccaucgugguuccgccuaauggcuacuuucgguucgaagccugggucaaccaguuuuauacacugacgcccaugggaaccggccaggggagacgccggaaucaauga

SEQ ID NO: 28712 - RNA, 1623 nt, Artificial Sequence; identical to SEQ ID NO: 26932
  derived and/or modified sequence opt5 from major_capsid_protein__Norovirus__ALA27427

SEQ ID NO: 28713 - RNA, 1623 nt, Artificial Sequence
  derived and/or modified sequence opt5 from major_capsid_protein__Norovirus__ALD09618
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaagauucucuuugccgcggugccucccaauuucccugucgaguuucugucucccgcccagaucaccaugcuuccgcaucugaucguggacguuagaacacucgaaccuauuaugaucccccugccugaugcucggaacaccuucuuucacuauagcaaucagcccaacucccgcaugagacuuguggccaugcuguacacaccccuccggucuaacggcagcggggacgaugucuucaccguguccugccgcgugcugacgagaccuaccccggacuuugaguucacauaucugguucccccuagcgucgaaucuaagaccaaacccuuuucccucccuauucugacacuuagcgagcugaccaauucucgguuccccgugccgaucgauucccucuuuacggcucaaaacaaugugcugcagguccagugucagaacggacgcugcacacuugacggcgagcugcaagggaccacacagcuccugccuagcggaauuugugccuucagaggccgggugaccgcccagaucaaucagcgcgauagauggcauaugcaacugcagaaccucaauggcaccacauacgaccccacggaugacguuccugcuccccuggggaccccugacuucaagggaguggucuuuggcauggugucucagcggaacguugggaaugaugcgcccggauccacacgcgcccaacaggcuugggugagcaccuauuccccgcaguucgucccuaaacuuggcucugugaaccugagaauuagcgacaaugaugacuuucaguuccaacccacaaaguuuacccccgucggggugaacgaugacgaugacggacacccuuuccggcagugggaacucccgaauuacuccggcgagcugacgcuuaacaugaaucuggcucccccuguugcccccaacuuuccuggcgaacagcuccuguucuuucgcagcuucgugcccugcucugggggauacaaccagggcaucaucgauugucugauuccucaagaguggauccagcauuuuuaucaggaauccgcccccagccagucugacgucgcccucauuagauacgugaauccggauacagggcggacccuguucgaggcgaaacuucacagaagcggauauaucaccguugcucacuccggcgacuacccucuggugguccccgccaacgggcauuuucgcuucgacucuugggugaaucaauucuauagccucgccccuaugggcacaggaaacggccggagacgcgcucaguga

SEQ ID NO: 28714 - RNA, 1623 nt, Artificial Sequence
  derived and/or modified sequence opt5 from major_capsid_protein__Norovirus__ALM96644
augaagauggccagcuccgacgcuaaccccucugauggcagcaccgccaaucugaucccugaggugaacaaugaagucauggcgcucgagccgguugugggggcugccauugccgcucccguggccggacagcaaaacgucaucgacccuuggauuagaaauaacuucgugcaggcucccggcggggaauuuacaguuuccccucggaaugcccccggagagauccuguggucugcgccucuuggcccggaucugaaccccuaccucagccaccuggcccgcauguauaauggguacgcuggaggcuucgaagugcaggucauucuugccggcaacgcuuuuacggccgggaaaaucaucuucgcggccgugccucccaauuuuccuaccgagggacugucccccucucagguuacaauguucccgcauauuaucguggacgucagacaacucgagccugugcugauuccccugccugaugugcggaacaauuuuuaucacuacaaccagagcaaugacuccaccaucaagcucauugcuaugcuguauacaccccuucgcgccaacaacgcuggcgaugacaucuucaccgucagcugcagaguucugacacggcccucuccugauuuugacuucauuuuucucgugccgcccaccguggaaucccgcacgaaaccuuucagcguccccgugcugaccguugaggaaaugacaaauucuagauuuccuaucccccuugagaagcuguucaccgggccguccagcgcccucgugguccagccucagaacggacgguguacaaccgauggcgugcugcuggggacgacacaacucucucccguuaauaucugcaccuuccgcggagacgugacacauauuccuggcuccagaaacuacaccaugaaucuggccagccagaacuggaacuccuaugaucccaccgaggaaaucccugcuccccuuggcacaccggacuuugucgggaaaauucagggagugcugacgcagaccacacggaccaauggcucuacacgcgggcacaaggcgaccgucuacacgggaagcgccgacuucuccccuaagcucggcagagugcaauuugcuacagauaccgacaaugauuucgagaccaaccagaauacaaaauuuacccccguuggggugauccaggacggaagcacaacgccccggaacgaaccucaacaguggguccugccgucuuacuccggccgcaauauucauaacgugcaccuugcccccgccguugcuccuaccuuccccggcgagcagcugcucuuuuucagaagcacaaugccuggguguucuggauaucccaauauggaucuggacugccugcucccucaggaaugggugcaauacuuuuaucaggaggccgcgcccgcucagagcgaugucgcccugcuucgguucgugaacccggacaccggcagagugcuguuugaguguaagcuccacaaauccggguacguuacagucgcccauaccggacagcacgaucuggugaucccucccaacggcuauuuccgcuuugacucuugggugaaucaauucuacacgcuugcuccuauggggaacggcaccggacggagacgcgcccuguga

SEQ ID NO: 28715 - RNA, 1623 nt, Artificial Sequence
  derived and/or modified sequence opt5 from major_capsid_protein__Norovirus__ALM96645
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcggggauguuuucaccgugagcugcagagugcugacacggcccucuccugacuuugauuucauuuuucucgucccgcccaccguggaaucccgcacgaaaccuuucagcguucccgugcugaccgucgaggaaaugacaaauucuagauuuccuaucccccuugagaagcuguucaccggaccguccagcgccuucgugguucagccucagaacggccgguguacaaccgacggggugcuccugggaacgacacaacugucucccgucaauauuugcaccuuucgcggcgaugugacacauaucccuggcuccagaaacuacaccaugaaucucgccagccagaacuggaacuccuaugaccccaccgaggaaaucccugcuccccuggggacaccggauuucgucggaaaagugcagggcguucuuacgcagaccacacggaccaaugggucuacacgcggacacaaggcgaccguguacacgggcagcgccgacuuuuccccuaagcuggggagaguccaauucgcuacagacaccgauaaugacuuugagaccaaccagaauacaaaauucacccccgugggaguuauucaggauggcagcacaacgccccggaacgaaccucaacagugggugcucccgucuuacuccggccgcaauauccauaacguccaccuggcccccgccguggcuccuaccuuucccggggagcagcuucuguucuuuagaagcacaaugccuggauguucuggcuaucccaauauggaccucgauugccugcugccucaggaaugggugcaauacuucuaucaggaggccgcgcccgcucagagcgacguugcccuccugcgguuugucaacccggauaccgugagagugcuuuucgaguguaagcugcacaaauccggguacgucacaguggcccauaccggacagcacgaccucguuauuccucccaacggcuauuuucgcuucgauucuugggugaaucaauucuacacgcuggcuccuauggggaacggcaccggacggagacgcgcccuuuga

SEQ ID NO: 28716 - RNA, 1623 nt, Artificial Sequence
  derived and/or modified sequence opt5 from major_capsid_protein__Norovirus__ALM96646
augaagauggccagcaacgacgcuaaucccuccgauggcucugccgcgaaccuggugccuaaagucaauaacgagguuauggcucucgaaccgguggugggggccgccaucgcugcccccgucgcuggacagcaaaaugugauugacccuuggaucaagaacaauuucguucaggcccccggcgggaaauuuaccgugagcccuaagaacgcgcccggagagauucugugguccgccccucuuggcccggaucugaaucccuaccucucucaccuggcuagaauguauaaagggcaugccggaggcuucgaaguccaggugauccuugcuggcaacgccuuuacagcggggaagauuaucuucgccgcuguuccucccaauuuuccuacggagggacugagccccucccaggugaccauguucccgcacaucauugucgacgugcggcaacucgaaccugugcugaucccccugccugauguccgcaacaauuuuuaccauuauaaccagucuaaugacagcacaauuaagcucaucgccaugcuguacacaccccuuagagcuaacaacgccggcgaggauguuuucaccguguccugccgggugcugacccgccccagcccugacuuugauuucauuuuucucgucccgcccacaguggagucuagaaccaaaccuuucacgguucccauccugaccguggaagagaugacaaauucccgguuuccuauuccccuugaaaagcuguucaccgggccgagcucugccuucgucgugcagccucagaacggacgcuguacaaccgacggcguucuccuggggacgacacaacugucccccgugaauaucugcaccuuuagaggagaugucacacacaucgcuggcagccggaacuauaccaugaaucucgcgucucugaacuggaauaacuacgacccuaccgaggagauucccgccccucuuggcacacccgauuucguggggaaaauccagggaguccugacgcagaccacaaagggcgacggguccacccgcggacauaaagcuacaguguauaccggcagcgccccguuuacgccuaagcucggguccguucaguucucuacagacaccgaaaaugauuuugagacccaccaaaacacaaaguucacccccgugggagucauucaggacggcggcacaacgcacagaaaugaaccccagcaaugggugcugccuagcuacuccgggcggaacguuccgaaugugcaucuugcccccgcugucgccccuaccuuucccggagagcagcuccuguucuuucgcagcacaaugccuggcuguucuggguaccccaacauggaucuggacugccugcucccucaggaaugggugcagcacuucuaucaagaggcggcucccgcccaguccgauguggcccugcuuagauuuguuaauccggacaccggacggguccuguucgaguguaaacuccauaagagcggcuacgugacaguggcucacaccgggcagcacgaucuggucaucccucccaacggcuauuuucgcuucgacucuugggugaaccaguucuacacgcuugccccuaugggaaauggcaccgggagacggagagcucuguga

SEQ ID NO: 28717 - RNA, 1623 nt, Artificial Sequence
  derived and/or modified sequence opt5 from major_capsid_protein__Norovirus__ALM96647
augaagauggccagcaacgacgcuaaucccuccgauggcucugccgcgaaccuggugccuaaagucaauaacgagguuauggcucucgaaccgguggugggggccgccaucgcugcccccgucgcuggacagcaaaaugugauugacccuuggaucagaaacaauuucguucaggcccccggcgggaaguuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgaaccugugcugaucccccugccugauguccggaauaacuuuuaucacuacaaucagucuaacgacagcacaauuaagcucaucgccaugcuguauacaccccuucgcgcuaacaaugccggcgaggauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugaaaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaggagauucccgccccucuugggacacccgauuucgugggaaagauccagggcguccugacgcagaccacaaaaggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcgggacaacgcaccgcaacgaaccccagcaaugggugcugccuucuuacagcggaagaaauguucacaacgugcaucuugccccggcugucgcccccaccuuuccuggcgagcagcuccuguucuuucgguccacaaugcccggguguagcggauauccuaauauggaucuggacugccugcucccccaggaaugggugcagcacuucuaccaagaggcggcuccugcccagucugauguggcccugcuucgcuuuguuaaccccgacaccggcagaguccuguucgaguguaaacuccauaaguccggguaugugacaguggcucacaccggccagcacgaucuggucaucccgccuaacggauacuuucgguucgacagcugggugaaucaguucuauacgcuugcccccaugggcaacgggaccggaagacgccgggcucuguga

SEQ ID NO: 28718 - RNA, 1623 nt, Artificial Sequence; identical to SEQ ID NO: 27460
  derived and/or modified sequence opt5 from major_capsid_protein__Norovirus__ALM98891

SEQ ID NO: 28719 - RNA, 1623 nt, Artificial Sequence; identical to SEQ ID NO: 27460
  derived and/or modified sequence opt5 from major_capsid_protein__Norovirus__ALM98892

SEQ ID NO: 28720 - RNA, 1623 nt, Artificial Sequence; identical to SEQ ID NO: 27460
  derived and/or modified sequence opt5 from major_capsid_protein__Norovirus__ALM98893

SEQ ID NO: 28721 - RNA, 1623 nt, Artificial Sequence; identical to SEQ ID NO: 27460
  derived and/or modified sequence opt5 from major_capsid_protein__Norovirus__ALM98894

SEQ ID NO: 28722 - RNA, 1623 nt, Artificial Sequence; identical to SEQ ID NO: 27460
  derived and/or modified sequence opt5 from major_capsid_protein__Norovirus__ALM98895

SEQ ID NO: 28723 - RNA, 1623 nt, Artificial Sequence; identical to SEQ ID NO: 26819
  derived and/or modified sequence opt5 from major_capsid_protein__Norovirus__ALM98896

SEQ ID NO: 28724 - RNA, 1623 nt, Artificial Sequence; identical to SEQ ID NO: 27460
  derived and/or modified sequence opt5 from major_capsid_protein__Norovirus__ALM98897

SEQ ID NO: 28725 - RNA, 1623 nt, Artificial Sequence; identical to SEQ ID NO: 27460
  derived and/or modified sequence opt5 from major_capsid_protein__Norovirus__ALM98899

SEQ ID NO: 28726 - RNA, 1623 nt, Artificial Sequence; identical to SEQ ID NO: 27137
  derived and/or modified sequence opt5 from major_capsid_protein__Norovirus__ALM98901

SEQ ID NO: 28727 - RNA, 1623 nt, Artificial Sequence
  derived and/or modified sequence opt5 from major_capsid_protein__Norovirus__ALM98907
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaggcaccacacaucgcaacgagccccaacaguggguccucccuagcuacuccggcagaaauauuccgaacgugcaccuggcucccgccguggcgccuacguuucccggggaacagcuucuguucuuucggagcaccaugccuggauguucuggcuaucccaauauggaccucgauugccugcugccucaggaguggguucaauacuucuaucaggaggcugcccccgcccaguccgacgucgcucuccugagauuugugaacccggauacagggcgcgugcuuuucgaauguaagcugcacaaaagcggauacgucaccguggcccauacaggccagcacgaccucguuaucccucccaauggguauuuucgguucgauucuugggugaaccaauucuacacccuggcuccuaugggcaacggaacgggcagacgccgggcccuuuga

SEQ ID NO: 28728 - RNA, 1623 nt, Artificial Sequence
  derived and/or modified sequence opt5 from major_capsid_protein__Norovirus__ALM98910
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggaccucgauugccugcugccucaggaguggguucaauacuucuaucaggacgcugcccccgcccaguccgaugucgcucuccugcgguuugugaacccggacaccgggagagugcuuuucgaguguaagcugcauaaaagcggauacgucacaguggcccacaccggccagcaugaucucguuauuccucccaauggguauuuucgcuucgacucuugggugaaccaauucuacacgcuggcuccuaugggcaacggaaccggccggagacgcgcccuuuga

SEQ ID NO: 28729 - RNA, 1623 nt, Artificial Sequence
  derived and/or modified sequence opt5 from major_capsid_protein__Norovirus__ALM98913
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccgauagagacuuugaagccaaccagaauaccaaauucacacccguuggggugauccaggauggaggcaccacacaccggaacgagccccaacaguggguccucccuagcuacuccggccgcagcacgccgaaugugcaccuggcucccgccguggcgccuaccuuucccggggaacagcuucuguucuuuagaucuacaaugccuggauguuccggcuaucccaacauggaccucgauugccugcugccucaggaguggguucaauacuucuaucaggaggcugcccccgcccagagcgacgucgcucuccugcgguuugugaauccggauaccgggagagugcuuuucgaauguaagcugcauaaaucuggauacgucacaguggcccacaccggccagcaugaccucguuauuccucccaacggguauuuucgcuucgauagcugggugaaucaauucuacacgcuggcuccuaugggcaacggaaccggccggagacgcgcccuuuga

SEQ ID NO: 28730 - RNA, 1623 nt, Artificial Sequence; identical to SEQ ID NO: 27328
  derived and/or modified sequence opt5 from major_capsid_protein__Norovirus__ALM98916

SEQ ID NO: 28731 - RNA, 1623 nt, Artificial Sequence
  derived and/or modified sequence opt5 from major_capsid_protein__Norovirus__ALT54478
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacgggccgacggcuccacccgcgggcacaaggcuacagucuacaccggaucugccgauuuugccccuaagcugggcagagugcaauucgagacggacacagaucaugacuuugaagcuaaccagaauaccaaauucacccccguuggggugauccaggauggaggcacaacccaccggaacgagccccaacaguggguccucccuagcuacuccggccgcaauacaccgaacgugcaccuggcccccgcgguggcuccuacguuucccggggaacagcuucuguucuuuagaagcaccaugccuggauguucuggcuaucccaauauggaccucgauugccugcugccucaggaguggguucaauacuucuaucaggaggccgcccccgcucaguccgacgucgcccuccugcgguuugugaacccggauacagggagagugcuuuucgaauguaagcugcauaaaagcggauacgucaccguggcucacacaggccagcaugaccucguuauuccucccaauggguauuuucgcuucgauucuugggugaaccaauucuacacccuggccccuaugggcaacggaacgggccggagacgcgcgcuuuga

SEQ ID NO: 28732 - RNA, 1617 nt, Artificial Sequence
  derived and/or modified sequence opt5 from major_capsid_protein__Norovirus__ALT54488
augaugauggccagcaaggacgcucccuccaacauggauggcaccucuggggccggacagcuggugccugaagucaaugcggcugaaccgcucccccuggagccuguugugggcgccgccacagcugccgcuacggccgggcaagugaacaugaucgaccccuggauuaugaauaacuucguccaggcgccugaaggagaguuuaccaucagccccaauaacacaccuggcgauauucuuuucgaccugagacucgggccgcaccugaaucccuuucuucugcaucucucccagauguacaacggaugggugggcaauaugcggguucgcgugaugcuggccggcaacgcuuucucugccgggaaaaucauuaucugcugugucccucccggauuugaaagccagaauaucuccauuggccaagcuaccauguucccucacgugaucgccgauguuagagugcuggagcccauugaggucccgcucgacgaugugcggaacgugcuguuucauacaaaugaaaaccgcccuaccaugagacuucugugcaugcucuauacaccccugcgggccgggggagccucuagcggcaccgacccuuucgucaucgcugggcgcguucuuacgugucccgcccccgauuuuaauuuccuguuucucgugccuccguccguggagcagaagaccagacagcugacaauucccaacaucccucugaacaaucucgcuaacagccggguccccgccaugauuaauaaaaugaccgugucugccgaccagaaccaaguugugcaguuccagaauggacgcugcacacuggaaggccagcuucugggcaccacgccugucuccgcuaaccaaguggcgagaauccgggggaagguuuuuagcacaaauucuggaaccggccucaaccugacagagguggaugggacccccuaccacgccuucgaguccccggcuccucuuggauuccccgacaucggcaauugugauuggcaugucuaugccuuuaaagugaaccagaauaccggggacccuauguaccgccuggacauuacacagggaaacagcuucgcgccccaccucggcucuaucgaauuuuccagcgagaaucacccuuccggcgaucaacuggggacgcugaccuggauuucuccccucaacaaugcuagcagagucgacccguggaagaucccuacauauggauccacccugacagaaagcaccaaccuugccccucccauuuuucccccgggcuucggggagucuaucguguacuucauguccgauuuucccaucguuagcggaaacacggcgcagauuccuugcacacugccccaggaguucgugucuagcuuugucgaacagcaagcuccuauccggggcgaggccgcccuccugcauuauguggaccccgauacccaccgcaaucuuggggaguucaagcuguacccugacggcuuuauuaccuguguucccaacacaggaggcgggccgcagaaucucccuuccaacggaguguucgucuuuucuagcuggguguccagauacuaucagcugaaacccgugggcaccacagggccuguucggagacugggaguccgccggguguga

SEQ ID NO: 28733 - RNA, 1620 nt, Artificial Sequence
  derived and/or modified sequence opt5 from major_capsid_protein__Norovirus__ALT54491
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaggacuccacaauuaaacucaucgccaugcuguauacaccccuucgcgcuaauaacgccggcgaugacguuuucaccgugagcugcagagugcugacccggcccucuccugauuuugacuucauuuuucucgucccgcccacaguggaaucccgcaccaagccuuucacgguucccauccugaccguggaggaaaugacaaacagcagauuuccuauuccccuugagaaacuguucaccgggccgucuaaugccuucgucgugcagccucagaacggacgguguacaaccgauggcguucuccuggggacgacacaacugucccccgugaauaucugcaccuuucgcggagacgucacacagaucgcuagcacccagaccuacacaaugaaccucgcgucucugaauuggaacaauuaugauccuacggaggaaauucccgccccucuuggcgcucccgacuucaugggcaagauccagggggugcugacccaaacaaccagacagggaggcuccacacgggggcauaaggccaccgucagcacgggauccgugcacuuuacaccgaaacucggcucuguucgcuucgacaccgauaccaacaaugaccugcagccucaucaaagcacaagauuuacccccgugggggucauucaggauggagacacacaccagaacgagccccagcaaugggcccuuccuuguuacuccggccgggaugugaauaacguucaccuggcuccggccguggcgcccagcuucccuggcgaacagcuccuguuuuuccgcucuacgaugcccgggugcuccggauacccuaauauggaccuggauugucuccugccccaggaguggguccagcauuuuuaucaagaagcugccccugcccagagcgacguggcccuucugagauucgugaaccccgauaccggccggguucucuuugagugcaagcugcacaaaucuggguacgucacaguggcucauaccggacagcacaaucuugugaucccgccuaacggcuauuucagauuugacagcugggucaaccaguucuacacacuggcucccauggggaauggcaccggacgccggagagugcucuga

SEQ ID NO: 28734 - RNA, 1620 nt, Artificial Sequence
  derived and/or modified sequence opt5 from major_capsid_protein__Norovirus__ALT54494
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaggacuccacaauuaaacucaucgccaugcuguauacaccccuucgcgcuaauaacgccggcgaugacguuuucaccgugagcugcagagugcugacccggcccucuccugauuuugacuucauuuuucucgucccgcccacaguggaaucccgcaccaagccuuucacgguucccauccugaccguggaggaaaugacaaacagcagauuuccuauuccccuugagaaacuguucaccgggccgucuaaugccuucgucgugcagccucagaacggacgguguacaaccgauggcguucuccuggggacgacacaacugucccccgugaauaucugcaccuuucgcggagacgucacacagaucgcuagcacccagaccuacacaaugaaccucgcgucucugaauuggaacaauuaugauccuacggaggaaauucccgccccucuuggcgcucccgacuucaugggcaagauccagggggugcugacccaaacaaccagacaggacggauccacacggggccauaaggccaccgucagcacgggguccgugcacuuuacaccgaaacucggaucuguucgcuucgauaccgacaccaacaauaaccugcagccucaucaaagcacaagauuuacccccgugggcgucauucaggauggggacacacaccagaaugagccccagcaaugggugcuuccuuguuacuccggacgggauguuaacaaugugcaccuggccccggcugucgcccccagcuucccuggcgaacagcuccuguuuuuccgcucuacgaugcccggcugcuccggguacccuaacauggaccuggauugucuccugccccaggagugggugcagcauuuuuaucaagaagcggcuccugcccagagcgacguggcccuucugagauucguuaaucccgauaccggacggguccucuuugagugcaagcugcacaaaucuggcuacgugacaguggcucauaccgggcagcacaaccuugucaucccgccuaacggauauuucagauuugacagcugggugaaucaguucuacacacuggcccccaugggcaacgggaccggccgccggagaguucucuga

SEQ ID NO: 28735 - RNA, 1620 nt, Artificial Sequence
  derived and/or modified sequence opt5 from major_capsid_protein__Norovirus__BAM65003
augaugauggccagcaaggacgcucccuccaacauggauggcaccucuggggccggacagcuggugccugaggucaaugcggcugaaccgcucccccuggagccuguugugggcgccgccacagcugccgcuacggccgggcaagugaaccuuaucgaccccuggauuaugaauaacuucguccaggcgccugaaggagaguuuaccaucagccccaauaacacaccuggcgauauucuguucgaccuccagcuggggccgcaccuuaaucccuuucugcagcaucucucccaaauguacaacggaugggugggcaauaugagaguucgggugaugcuggccggcaacgcuuucaccgccgggaaaaucauuaucugcugugucccucccggauuugcuucucagaauaucagcauuggccaggccacaauguucccucacgugaucgcggauguucgcgugcuggaacccauugagaucccgcucgacgaugucagaaacgugcuguuucauaccaaugagaaccggccuacaaugcgccuucugugcaugcucuauacgccccugagagccgggggagcuuccucuggcaccgacccuuucgugauugccgggcggguccuuaccugucccagccccgauuuuaauuuccuguuucucguuccuccguccguggaacagaagacacgccaacugaccgugcccaacaucccucugaacaaucucgcuaacagcagaguccccgccaugauuaauaaaaugacagugucuaccgaccagaaccagguugugcaguuccaaaauggacggugcacgcuggagggccagcuucugggcacaaccccugucuccgccagccagguggcucgcaucagagggaagguguuuucuacagcguccggaaaaggccucaaccugaccgaacuugaugggacccccuaccacgccuucgagagcccggcuccucugggauuccccgacaucggcgccugugauuggcauguuucuacauuuaaggucgaccaaaaucucuccggggacccuaugagccggcuggauauuaagcagaacgcccccuucgcuccucaccugggauccaucgaguuuacgucugaccaggaacccaccggcgaucagcucggcacacuggccugggugagcccguccaccagcggggcgcgcgucgacccuuggaaaauucccucuuauggauccacagugaccgagagcacgcaccuugcucccccuaucuucccgcccggcuuuggggaagccauuguuuacuucaugucugauuuuccuaucgugagcggaaauacagcccaaguccccugcacccugccucaggaguucgugucccauuuuguugaacagcaggcucccaucagaggcgaggccgcucuccugcacuauguggacccugauacccaucggaaccuuggggaguucaagcuguaccccgacggcuuuauuacaugugucccgaauaccggaggcgggccucaaaaccuccccaucaauggaguguucguguuuucuagcuggguuucccgcuauuaccagcugaaaccugucggcacagccgggcccgcgagacggcugggagugagacgcguguga

SEQ ID NO: 28736 - RNA, 1647 nt, Artificial Sequence
  derived and/or modified sequence opt5 from major_capsid_protein__Norovirus__BAM65005
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaaaucaucuucgcugccauucccccuaacuuucccaucgacaaucuguccgcugcccagauuaccaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagcuaauaacuccggggacgaugucuucaccgugucuugucgggugcugacacgcccuagccccgacuuuuccuucaauuuucuuguucccccuaccgucgaaagcaagacaaaaccguucacccugcccauccucacgauuucugagauguccaacagcagauuuccugugcccaucgauucucugcauaccuccccuacagaaaauaucgugguccagugccagaacggacgggugacccuggacggcgagcucauggggacaacccaacugcuucccagccagauuugugcguuccgcggaguucugacgagaucuacaucccgggccagcgaucaggcugacaccgccacaccgcgccucuucaauuauuacuggcacauccagcuggacaaccuuaauggcaccccuuaugaucccgccgaggacauuccuggcccccuggggaccccugauuuuagaggaaagguguucggcgucgcuucccaacggaaccccgacucuacaacgcgcgcccaugaagcgaaaguggauaccacaagcgggagauuuaccccgaagcucggaucccuggagaucagcacagaaucuggcgacuucgaucagaaucagccuacccgguuuacgcccguugggauuggaguggacaacgaggcugauuuccaacaguggucccugcccgacuacagcggccaguuuacacacaauaugaaccucgccccugccgucgcuccgaauuuccccggcgaacagcugcuguuuuucagaucucaacuuccuagcuccgggggacgcucuaacggcauccucgauugccuggugccccaggaguggguccagcacuuuuaccaggagagcgccccugcucaaacccagguggcccuuguucgguaugugaaccccgacaccgggagaguccuguucgaagcgaagcuccauaaacugggauuuaugacaaucgccaaguccggcgacagcccuauuaccgugcccccgaauggguacuuccgcuucgagucuuggguuaacccuuuuuauacacuggcucccaugggcacgggaaauggccggagacgcauccaguga

SEQ ID NO: 28737 - RNA, 1644 nt, Artificial Sequence
  derived and/or modified sequence opt5 from major_capsid_protein__Norovirus__BAM65007
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccccuaucgauaugcucuauacagaccccaaugaaggcauugugguccaaccgcagaacgggagaugcacccuggauggaacacuucagggcaccacgcagcuggugccuacacaaaucugugccuuucgggggacccucauuggacagacaucccgcagcucugacuccaccgauagcgcucccagacggcgcgaccacccucugcauguucagcuuaagaaucuggauggcacccaauacgaccccacagacgaggugccugcgguccucggcgccaucgauuucaaagggacgguguucggagucgcuucucagagagacguguccggccagcagguuggggccacccgggcccacgaagugcacaucaacacaaccgaucccagauauacaccgaagcugggaagcauucugaugcauuccgagucugacgauuuugucaccggccaaccugugcgcuucacgcccaucgggaugggagacaaugauuggcaccagugggagcuccccgacuacagcggccaucugacacuuaacaugaaucuggcuccugccguugcgccggcuuuucccggcgaacggauucucuucuuuagauccaucgugccuagcgccgggggauacggcucugggcagauugauugccugaucccccaggaguggguccaacacuucuaucaggaagccgcuccuucccagagcgccguggcucuuauccgcuacgugaaccccgacaccggacggaauauuuuugaggccaagcugcacagagaaggcuucaucaccguugcgaacucugggaauaacccuauugucgugcccccgaauggcuauuuucgcuucgaggccugggugaaccaguuuuacacacucaccccuaugggaacaggccaagggcggagacgcaaucaguga

SEQ ID NO: 28738 - RNA, 1623 nt, Artificial Sequence; identical to SEQ ID NO: 26482
  derived and/or modified sequence opt5 from major_capsid_protein__Norovirus__CCX28604

SEQ ID NO: 28739 - RNA, 1623 nt, Artificial Sequence
  derived and/or modified sequence opt5 from major_capsid_protein__Norovirus__CCX28607
augaagauggccagcuccgacgcuaaccccucugauggcagcaccgccaaucuggugccugaggucaacaaugaaguuauggcgcucgagccgguggugggggcugccaucgccgcucccgucgccggacagcaaaacauuaucgacccuuggauuagaaauaacuucgugcaggcucccggcggggaauuuacaguuuccccucggaaugcccccggagagauccuguggucugcgccucuuggcccggaucugaaccccuaccucagccaccuggcccgcauguauaauggguacgcuggaggcuucgaagugcaggucauucuugccggcaacgcuuuuacggccgggaaaaucaucuucgcggccgugccucccaauuuuccuaccgagggacugucccccucucagguuacaauguucccgcauauuaucguggacgucagacaacucgagccugugcuggugccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucuagaaacuacaccaugaaucucgcuucccagaacuggaauagcuaugaucccaccgaggaaauuccugcgccccugggcacaccggacuucguggggaaaauccagggaguccuuacgcagaccacacggaccgacggcuccacacgcgggcacaaggccaccguguacacgggaucugcugauuuuagcccuaagcugggcagaguucaauucgccacagacaccgauaacgacuuugaggccaaucagaacaccaaauucacacccgugggggucauucaggauggauccaccgcucaucggaaugaaccccaacagugggugcucccuagcuacucuggccgcaacauccacaauguucaccuggccccggcgguggcucccacauuuccuggcgagcagcuucuguucuuuagauccacgaugcccggguguagcggauauccuaacauggaccucgauugccugcugccccaggaauggguccaauacuucuaucaggaggccgccccugcucagucugacguggcccuccugcgguuugugaaucccgauaccggcagaguucuuuucgaguguaagcugcauaaaccgggguacgucacaguggcucacaccggacagcaugaccucgugauuccucccaacggcuauuuucgcuucgauagcugggucaaccaauucuacacacuggccccuauggggaauggcaccggacggagacgcgcgcuuuga

SEQ ID NO: 28740 - RNA, 1623 nt, Artificial Sequence
  derived and/or modified sequence opt5 from major_capsid_protein__Norovirus__CCX28619
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauauccccggcucucacaacuacaccaugaaucucgccucccagaacuggaauagcuaugauccuaccgaggaaauucccgcuccgcugggcacaccugacuucguggggaaaauccagggaguccuuacgcagaccacaagaaccaacggcuccacacgggggcauaaggcgaccguguacacgggaucugccgacuuuagccccaagcugggccgcguucaauucgcuacagauaccgacaaugauuuugagaccaaccagaauacaaaauucacccccgugggggucauucaggacggauccacaacgccuagaaacgaaccgcaacagugggugcuccccagcuacucuggccggaauauccacaacguucaccuggccccugccguggcucccaccuuuccuggcgagcagcuucuguucuuucgcuccacaaugcccggguguagcggauauccuaauauggaucucgacugccugcugccccaggaauggguccaauacuucuaucaggaggccgcgccggcucagucugauguggcccuccugagauuugugaacccugacaccggccggguucuuuucgaguguaagcugcauaaaagcggguacgucacaguggcccacaccggacagcaugaucucgugauucccccuaacggcuauuuuagauucgacuccugggucaaucaauucuacacgcuggcucccauggggaacggcaccggacgccggagagcccuuuga

SEQ ID NO: 28741 - RNA, 1623 nt, Artificial Sequence
  derived and/or modified sequence opt5 from major_capsid_protein__Norovirus__CCX28622
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauaucuccggcagcagaaauuacaccaugaaccucgccgcucagaauuggaacuccuaugaucccaccgaggaaaucccugcgccccugggcacaccggacuucgucgggaaaauucagggagugcuuacgcagaccacaaagaccaauggcucuacacgggggcacaaggccaccguuuacacgggaagcgcugacuuuuccccuaaacugggccgcgugcaauucgccacagauaccgacaacgauuuugagaccaaucagaacacaaaguucacccccgucggggugauccaggacggaagcacaacgcccagaaaugaaccucaacaguggguucucccgucuuacuccggccggaacacccauaaugugcaccuggcccccgcugucgccccuacauuucccggcgagcagcuucuguucuuucgcagcaccaugccuggguguucuggauaucccaacauggaucucgacugccugcugccucaggaaugggugcaauacuucuaucaggaggcggcucccgcccagagcgauguggcccuccugagauuuguuaauccggacacaggccggguccuuuucgaguguaaacugcacaaguccggguacgugaccguggcucauacgggacagcacgaucucgucauuccucccaacggcuauuuuagauucgacucuugggugaaccaauucuacacccuggccccuauggggaauggcacaggacgccggagagcucuuuga

SEQ ID NO: 28742 - RNA, 1623 nt, Artificial Sequence; identical to SEQ ID NO: 28740
  derived and/or modified sequence opt5 from major_capsid_protein__Norovirus__CCX28625

SEQ ID NO: 28743 - RNA, 1623 nt, Artificial Sequence; identical to SEQ ID NO: 28741
  derived and/or modified sequence opt5 from major_capsid_protein__Norovirus__CCX28628

SEQ ID NO: 28744 - RNA, 1623 nt, Artificial Sequence; identical to SEQ ID NO: 26482
  derived and/or modified sequence opt5 from major_capsid_protein__Norovirus__CCX28631

SEQ ID NO: 28745 - RNA, 1623 nt, Artificial Sequence; identical to SEQ ID NO: 28740
  derived and/or modified sequence opt5 from major_capsid_protein__Norovirus__CCX28634

SEQ ID NO: 28746 - RNA, 1623 nt, Artificial Sequence
  derived and/or modified sequence opt5 from major_capsid_protein__Norovirus__CCX28637
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgacagcaccauuaagcucaucgcuaugcuguauacaccccuucgcgccaauaacgcuggcgaugacguuuucaccgugucuugcagagugcugacacggcccuccccugauuuugacuucauuuuucucgucccgcccaccguggaaagccgcacgaaaccuuucucuguucccgugcugaccgucgaggaaaugacaaacuccagauuuccuaucccccuugagaagcuguucaccgggccgagcucugccuucgugguucagccucagaauggacgguguacaaccgauggcgugcuccuggggacgacacaacugucccccgucaacauuugcaccuuucgcggagacgugacacauaucagcggcuccagaaauuacaccaugaaccucgccucucagaauuggaacagcuaugauccuaccgaggaaauccccgcuccucugggcacacccgacuucgucgggaaaauucagggagugcuuacgcagaccacaaagaccaauggcuccacacgggggcacaaggcgaccguuuacacgggaagcgccgacuuuucuccgaaacugggccgcgugcaauucgcuacagauaccgacaacgauuuugagaccaaucagaacacaaaguucaccccugucggggugauccaggacggauccacaacgcccagaaaugaaccccaacaguggguucucccuagcuacucuggccggaacacccauaaugugcaccuggccccggccgucgcucccacauuuccuggcgagcagcuucuguucuuucgcagcaccaugcccggguguuccggauauccuaacauggaucucgacugccugcugccccaggaaugggugcaauacuucuaucaggaggccgcgccugcucagucugauguggcccuccugagauuuguuaaucccgacacaggccggguccuuuucgaguguaaacugcacaagagcggguacgugaccguggcccauacgggacagcacgaucucgucauuccgccuaacggcuauuuuagauucgacuccugggugaaccaauucuacacccuggcucccauggggaauggcacaggacgccggagagcccuuuga

SEQ ID NO: 28747 - RNA, 1623 nt, Artificial Sequence; identical to SEQ ID NO: 26482
  derived and/or modified sequence opt5 from major_capsid_protein__Norovirus__CCX28640

SEQ ID NO: 28748 - RNA, 1623 nt, Artificial Sequence; identical to SEQ ID NO: 28740
  derived and/or modified sequence opt5 from major_capsid_protein__Norovirus__CCX28643

SEQ ID NO: 28749 - RNA, 1623 nt, Artificial Sequence; identical to SEQ ID NO: 26482
  derived and/or modified sequence opt5 from major_capsid_protein__Norovirus__CCX28646

SEQ ID NO: 28750 - RNA, 1623 nt, Artificial Sequence; identical to SEQ ID NO: 26674
  derived and/or modified sequence opt5 from major_capsid_protein__Norovirus__CCX28649

SEQ ID NO: 28751 - RNA, 1623 nt, Artificial Sequence; identical to SEQ ID NO: 28741
  derived and/or modified sequence opt5 from major_capsid_protein__Norovirus__CCX28652

SEQ ID NO: 28752 - RNA, 1626 nt, Artificial Sequence; identical to SEQ ID NO: 26837
  derived and/or modified sequence opt5 from major_capsid_protein_VP1__Norovirus__AEE10000

SEQ ID NO: 28753 - RNA, 1626 nt, Artificial Sequence; identical to SEQ ID NO: 26840
  derived and/or modified sequence opt5 from major_capsid_protein_VP1__Norovirus__AEE10012

SEQ ID NO: 28754 - RNA, 1623 nt, Artificial Sequence; identical to SEQ ID NO: 27407
  derived and/or modified sequence opt5 from major_capsid_protein_VP1__Norovirus__AGJ52172

SEQ ID NO: 28755 - RNA, 1623 nt, Artificial Sequence; identical to SEQ ID NO: 27331
  derived and/or modified sequence opt5 from major_capsid_protein_VP1__Norovirus__AGJ52173

SEQ ID NO: 28756 - RNA, 1623 nt, Artificial Sequence; identical to SEQ ID NO: 27141
  derived and/or modified sequence opt5 from major_capsid_protein_VP1__Norovirus__AGJ52174

SEQ ID NO: 28757 - RNA, 1632 nt, Artificial Sequence; identical to SEQ ID NO: 27461
  derived and/or modified sequence opt5 from major_capsid_protein_VP1__Norovirus__AGJ52176

SEQ ID NO: 28758 - RNA, 1608 nt, Artificial Sequence
  derived and/or modified sequence opt5 from major_capsid_region__Norovirus__ADO85555
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccugucucgcauguauaauggguacgccggaggcguugaggugcagguccugcucgcuggcaacgccuucaccgcugggaaacugguguuugccgcgguucccccucauuucccccuugaaaauauuagcccuggacagaucacaauguuuccccacgugauuaucgaugucagaacccuggagccggugcuccugccucuucccgacgugcggaacaauuucuuucauuauaaccagcaaaacgaaccuuggaugcgccuggucgccaugcucuacacaccccugagauccaauggcucuggggaugacguuuucaccgugagcugccgggugcugacacgccccuccccugauuuugacuucaacuaucucgucccgcccaccguggagagcaagacgaaaccuuuuacccugcccauccuuacaauuggagagcugaccaauucuagauucccuguucccaucgaugaacucuacacauccccgaacgagagccuggugguccagccucagaauggccggugugcucuugacggggaacugcagggaaccacgcaacuccugcccacagccauuugcucuuuucgcggcagaaucaaccagaagguguccggcgagaaucacguuuggaacaugcaagugaccaauauuaacgggacaccuuucgaucccaccgaagacgucccugcuccccugggaaccccggauuucagcggcaaacucuuuggggugcugucucagcgggaccaugacaaugccugucgcucccacgaugccgucaucgcuacaaacagcgcgaaguucacgccuaaacuuggagccauucagaucggcaccugggaggagaaugacgugcacaucaaccagcccacaaaguuuacccccguugggcuguucgaauccgagggauuuaaucaguggacacucccuaacuauucuggcgcucugacccuuaacaugggccuggccccgcccguggccccuacguuccccggggaacaaauucucuuuuucagaagccauaucccucugaagggaggcgucgcugaucccgugauugacugccugcucccucaggaguggauccagcaccuguaccaggaauccgcccccagccaaacagauguugcgcuuauucggaucaccaauccggacaccgggcgcgugcuguuugaggcuaaacuccauagaucuggauacaucacagucgccaacaccggcucccggccuauuguggugcccgccaauggguauuucagauuugauagcuggguuaaccaguucuacucucuggcuccuaugggcacaggaaauggccgccggagaguccaguga

SEQ ID NO: 28759 - RNA, 1626 nt, Artificial Sequence
  derived and/or modified sequence opt5 from majore_capsid_protein__Norovirus__AFO84035
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcgcucuggaaccgauccaacuuccucugcucgaugugagacgggugcuguggcacgccacccaggaccaggaggaguccaugcgccuugucuguaugcuguauacaccccucagaaccaauucuccuggggaugaauccuuuguuguguccggacggcugcugagcaaacccgccgcugacuucaacuuuguguaccucacgcccccuauugagcgcaccaucuauagaauggucgaucugccggugcuucagccccggcugugcacacaugcgcgcuggccugcccccguuuacggccuccugguggacccuucucuucccuccaauccgcaauggcagaacgggagaguccacguggauggaacccugcucggcacaaccccuguuagcggcucuuggguguccuguuucgcugccgaagccgcuuaugaguaccagagcgaggucggggaaguggccacguuuacacugauugagcaagacggaucugcguacguccccggcgaucgggcugccccucugggguaucccgacuacuccggacagcucgaaaucgaggugcagaccgaaacaaccaagaccggcgacaaacugaagguuacaacguucgauaugauucuugggccuaccacaaauguggaccagguccccuaucaaggaaagguguacgccagccugaccacagcuuccucucucgaucugguugacggccgcgccagagcugugccgcggagcgucuauuccuuucaggaugugcuuccugaguacaacgacggccugcucgugccccuggcgcccccucuggggccguaucuccccggagagguucugcuucgcuucagaaccuacaugcggcagcuggauacggccgacgccgcugcccagccuaucgauugcgcucucccccaagaguucauuagcugguuugccucuaauaacuucacaguccaguccgacgcgcugcugaucagauaccgcaauacccuuaccggccagcuccuguuugaagccaaacuguauagcgaaggguacaucgcugugucuuauagcggauccggcccucucacauuccccaccgauggguuuuucgagguggucucuugggugccucggcuguuucagcuugccagcguuggcucccuggugacaggaagaacgcucaagcaauga

SEQ ID NO: 28760 - RNA, 1623 nt, Artificial Sequence
  derived and/or modified sequence opt5 from major_viral_capsid_protein__Norovirus__AFN09918
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaucuagagacggcuccacccgggggcacaaggccacggugagcacaggauccguucauuuuaccccuaagcugggcucugugcaguucagcaccgauacauccaaugacuuugagaccgggcagaacacacgcuucacgcccgucggagugguucaagauggcagcaccacacaccagaaugaaccccagcagugggugcucccuaacuacucuggcagagacucccacaauguccaucuggcuccggccguggcccccaccuuuccuggggagcaacuucuguucuuucggagcacaaugcccggauguucuggcuacccuaacaugaaucucgauugccugcugccccaggaaugggugcagcacuucuaucaggagagcgcuccugcccaauccgacguugcgcuccugcgcuuugucaaccccgauaccgggagagugcuuuucgaguguaaacugcauaagccgggauacgugacggucgcucacaccggccagcacgaccucgugauuccucccaacggguauuuucgguucgauucuuggguuaaucaguucuacacacuggccccuaugggcaacggagccggcagacgccgggcucuuuga

SEQ ID NO: 28761 - RNA, 1623 nt, Artificial Sequence; identical to SEQ ID NO: 26932
  derived and/or modified sequence opt5 from major_viral_capsid_protein__Norovirus__AFN09921

SEQ ID NO: 28762 - RNA, 1623 nt, Artificial Sequence
  derived and/or modified sequence opt5 from major_viral_capsid_protein__Norovirus__AFN09924
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagagacuacaccaugaaucucgcgagccugaacuggaauaacuaugauccuaccgaagagauucccgccccucuugggacacccgacuucgugggaaaaauccagggcguccugacgcagaccacaaaggggaauggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuauaucacaguggcucacaccgggcagcacgaucuggugauuccgccuaacggcuacuuucgguucgacucuugggucaaucaguucuauacgcuugcccccaugggaaacggcaccgggagacgccgggcucuguga

SEQ ID NO: 28763 - RNA, 1623 nt, Artificial Sequence; identical to SEQ ID NO: 26932
  derived and/or modified sequence opt5 from major_viral_capsid_protein__Norovirus__AFN09927

SEQ ID NO: 28764 - RNA, 1623 nt, Artificial Sequence
  derived and/or modified sequence opt5 from major_viral_capsid_protein__Norovirus__AFN09930
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagauuaccaagggcgacggguccacacggggacacaaggcuaccguguacacaggcggggccccguuuaccccuaaacucggaagcguucaguucuccacggacacagaaaacgauuuugagacccaucaaaauaccaaguucacacccgugggcgucauccaggacggcucuaccacacaccgcaacgaaccccagcaaugggugcugccuagcuacuccgggagaaauguucacaacgugcaucuugccccggcugucgcccccacguuuccuggagagcagcuccuguucuuucggagcaccaugcccggcuguucuggguauccuaauauggaucuggacugccugcucccccaggagugggugcagcacuucuaccaagaagcggcuccugcccaguccgauguggcccugcuucgcuuuguuaaccccgacacaggaagaguccuguucgaguguaaacuccauaagagcggcuaugugaccguggcucacacagggcagcacgaucuggucauuccgccuaacggcuacuuucgguucgacucuugggugaaucaguucuauacccuugcccccaugggaaacggcacggggagacgccgggcucuguga

SEQ ID NO: 28765 - RNA, 1623 nt, Artificial Sequence; identical to SEQ ID NO: 26932
  derived and/or modified sequence opt5 from major_viral_capsid_protein__Norovirus__AFN09933

SEQ ID NO: 28766 - RNA, 1623 nt, Artificial Sequence; identical to SEQ ID NO: 26932
  derived and/or modified sequence opt5 from major_viral_capsid_protein__Norovirus__AFN09936

SEQ ID NO: 28767 - RNA, 1623 nt, Artificial Sequence
  derived and/or modified sequence opt5 from major_viral_capsid_protein__Norovirus__AFN09939
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcggggccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuaugugacaguggcucacaccgggcagcacgaucuggucaucccgccuaacggcuacuuucgguucgacucuugggugaaucaguucuauacgcuugcccccaugggaaacggcaccgggagacgccgggcucuguga

SEQ ID NO: 28768 - RNA, 1623 nt, Artificial Sequence; identical to SEQ ID NO: 26932
  derived and/or modified sequence opt5 from major_viral_capsid_protein__Norovirus__AFN09942

SEQ ID NO: 28769 - RNA, 1623 nt, Artificial Sequence
  derived and/or modified sequence opt5 from major_viral_capsid_protein__Norovirus__AFN09945
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagccacaauuacaccaugaaccucgcgucucugaauuggaacaauuaugacccuaccgaagagauucccgccccucuuggcacacccgauuucguggggaaaauccagggaguccugacgcagaccacaaagggcgacggguccaccagaggacauaaggcuacaguguacaccggcagcgccccguuuacgccuaaacucggguccguucaguucucuacagacaccgaaaacgauuuugagacccaccaaaauacaaaguucacccccgugggagucauucaggacggcagcacaacgcaccggaacgaaccccagcaaugggugcugccuuccuacagcggcgggaauguucauaacgugcaccuugccccggcugucgcccccaccuuuccuggagagcagcuccuguucuuucgcucuacaaugcccggcuguuccggguauccuaauauggaucuggacugccugcucccccaggagugggugcagcauuucuaccaagaagcggcuccugcccagagcgauguggcccugcuuagauuuguuaaccccgacaccggacggguccuguucgaguguaaacuccacaagucuggcuaugugacaguggcucacaccgggcagcaugaucuggucaucccgccuaacggcuacuuucgcuucgacagcugggugaaucaguucuauacgcuugcccccaugggaaacggcaccgggagacggagagcucuguga

SEQ ID NO: 28770 - RNA, 1623 nt, Artificial Sequence
  derived and/or modified sequence opt5 from major_viral_capsid_protein__Norovirus__AFN09948
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugggccccagccaggugaccauguucccgcauaucauugucgacgugagacaacucgagccugugcugaucccccugccugauguccggaauaacuuuuaucacuacaaucaguccaacgacucuacaauuaagcucaucgccaugcuguauacaccccuucgcgcuaacaaugccggggaagauguuuucaccgugagcugcagagugcugacccggcccuccccugacuuugauuucauuuuucucgucccgcccacaguggagagccgcaccaaaccuuucacgguucccauccugaccguggaagagaugacaaacucuagauuuccuauuccccuugagaagcuguucaccggaccguccggcgccuucgucgugcagccucagaaugggcgguguacaaccgacggaguucuccugggcacgacacaacugagccccgugaacaucugcaccuuucgcggcgaugucacacauaucgcugggucuagaaauuacaccaugaaccucgcgucccugaauuggaacaauuaugacccuaccgaagagauucccgccccucuuggaacacccgauuucgugggcaaaauccaggggguccugacgcagaccacaaagggagacggcagcacccgggggcacaaggcuacaguguacaccggaggcgccccguuuacgccuaaacucggcucuguucaguucuccacagacaccgaaaacgauuuugagacccaucaaaauacaaaguucacccccgugggggucauucaggacggaagcacaacgcaccgcaacgaaccccagcaaugggugcugccuuccuacucuggcagaaauguucacaacgugcaucuugccccggcugucgcccccaccuuuccuggggagcagcuccuguucuuucggagcacaaugcccggauguuccggcuauccuaauauggaucuggacugccugcucccccaggagugggugcagcacuucuaccaagaagcggcuccugcccagagcgauguggcccugcuucgcuuuguuaaccccgacaccgggagaguccuguucgaguguaaacuccauaagucuggcuaugugacaguggcucacaccggacagcacgaucuggucaucccgccuaacggcuacuuucgguucgacuccugggugaaucaguucuauacgcuugcccccauggggaacggaaccggcagacgccgggcucuguga

SEQ ID NO: 28771 - RNA, 1623 nt, Artificial Sequence; identical to SEQ ID NO: 26932
  derived and/or modified sequence opt5 from major_viral_capsid_protein__Norovirus__AFN09951

SEQ ID NO: 28772 - RNA, 1623 nt, Artificial Sequence
  derived and/or modified sequence opt5 from major_viral_capsid_protein__Norovirus__AFN09954
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugaucucauuuuccuggucccgcccacaguggagucucgcaccaaaccuuuuacgguucccauccuuaccguggaagagaugacaaacuccagauucccuauuccccuggagaagcucuuuaccgggccgagcggagccuucgucgugcagccucagaauggccgguguacaaccgacgggguucugcugggaacgacacaacucucucccgugaacaucugcaccuuccgcggcgaugucacacauaucgcuggcuccagaaauuacaccaugaaccuggcgagccuuaauuggaacaauuaugacccuaccgaagagauucccgccccucuggggacacccgauuuugugggaaaaauccagggcguccucacgcagaccacaaagggggacggaucuacccggggccacaaggcuacaguguacaccgggggagccccguucacgccuaaacugggcuccguucaguuuagcacagacaccgaaaacgauuucgagacccaucaaaauacaaaguuuacccccgugggcgucauucaggacggguccacaacgcaccgcaacgaaccccagcaaugggugcuuccuucuuacagcggaagaaauguucacaacgugcaucuggccccggcugucgcccccaccuucccuggcgagcagcuccuguuuuuccgguccacaaugcccggguguagcggauauccuaauauggaucuggacugccuccugccccaggagugggugcagcacuuuuaccaagaagcggcuccugcccagucugauguggcccuucugcgcuucguuaaccccgacaccggcagaguccucuuugaguguaaacugcauaaguccggguaugugacaguggcucacaccggccagcacgaucuugucaucccgccuaacggauacuuccgguuugacagcugggugaaucaguucuauacgcuggcccccaugggcaacgggaccggaagacgccgggcucucuga

SEQ ID NO: 28773 - RNA, 1623 nt, Artificial Sequence
  derived and/or modified sequence opt5 from major_viral_capsid_protein__Norovirus__AFN09957
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccgggggagccccguuuacgccuaaacucggcuccguucaguucagcacagacaccgaaaacgauuuugagacccaucaaaauacaaaguucacccccgugggcgucauucaggacggguccacaacgcaccgcaacgaaccccagcaaugggugcugccuucuuacagcggaagaaauguucacaacgugcaucuugccccggcugucgcccccaccuuuccuggcgagcagcuccuguucuuucgguccacaaugcccggguguagcggauauccuaauauggaucuggacugccugcucccccaggagugggugcagcacuucuaccaagaagcggcuccugcccagucugauguggcccugcuucgcuuuguuaaccccgacaccggcagaguccuguucgaguguaaacuccauaaguccggguaugugacaguggcucacaccggccagcacgaucuggucaucccgccuaacggauacuuucgguucgacagcugggugaaucaguucuauacgcuugcccccaugggcaacgggaccggaagacgccgggcucuguga

SEQ ID NO: 28774 - RNA, 1623 nt, Artificial Sequence
  derived and/or modified sequence opt5 from major_viral_capsid_protein__Norovirus__AFN09960
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguuccgggggcgcagcucugcccucgucgugcauccgcagaauggaagauguaccacagacggcguucugcuggggaccacgcagcucuccccugugaacaucugcacauuccggggagaugucacccacaucgcuggcagccauaauuacacaaugaaccuggcgucucuuaauuggaacaauuaugaccccaccgaagagauuccugcuccccugggcaccccugauuuuguggggaaaauccaaggaguccucacacagacgaccaagggcgacggguccacacgcggacacaaggccaccguguacacaggcagcgcccccuucaccccgaaacugggguccguucaguuuucuacggacacagaaaacgauuucgagacccaccagaauaccaaguuuacaccugugggagucauucaagacggcagcaccacacauagaaacgaaccccagcagugggugcuucccuccuacagcggcgggaauguucacaacgugcaucuggccccugcugucgccccgacguuccccggagagcaacuccuguuuuuccggucuaccaugccuggcuguuccggguaucccaauauggaucuggacugccuccugccucaggagugggugcagcacuuuuaccaggaagcggcucccgcccaaagcgauguggcccuucugcgcuucguuaacccugacacaggaagaguccucuuugaguauaaacugcacaagucugauuacgugaccguggcucauacaggccagcacgaccuugucauucccccgaacggguauuuccgguuugauagcugggugaaucaguucuacacccuggccgcuaugggcaacggaacgggcagacgccgggcccucuga

SEQ ID NO: 28775 - RNA, 1623 nt, Artificial Sequence
  derived and/or modified sequence opt5 from major_viral_capsid_protein__Norovirus__AFN09963
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccuccuuuacgccgaaacucgggucuguucaguucagcacagauaccgagaacgacuuugaaacccaucaaaauacaaaguucaccccugugggagucauucaggauggcuccacaacgcaccgcaacgagccccagcaaugggugcugcccagcuacucuggcagaaauguucacaacgugcaucuugccccugcugucgccccgaccuuucccggggaacagcuccuguucuuucgguccacaaugccuggauguagcggcuaucccaauauggaccuggauugccugcucccucaggagugggugcagcacuucuaccaagaggcggcucccgcccagucugacguggcccugcuucgcuuuguuaacccugauaccgggagaguccuguucgaauguaaacuccauaagagcggauaugugacaguggcucacaccggccagcacgaccuggucauucccccgaacggguacuuucgguucgauuccugggugaaucaguucuauacgcuugccccuaugggcaacggaaccggcagacgccgggcucuguga

SEQ ID NO: 28776 - RNA, 1623 nt, Artificial Sequence; identical to SEQ ID NO: 26932
  derived and/or modified sequence opt5 from major_viral_capsid_protein__Norovirus__AFN09966

SEQ ID NO: 28777 - RNA, 1623 nt, Artificial Sequence; identical to SEQ ID NO: 27746
  derived and/or modified sequence opt5 from major_viral_capsid_protein__Norovirus__AFN09969

SEQ ID NO: 28778 - RNA, 1623 nt, Artificial Sequence
  derived and/or modified sequence opt5 from major_viral_capsid_protein__Norovirus__AFN09972
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcugacuuuacgccgaaacucgggagcguucaguucuccacagauaccgaaaaugacuuugagacccaucaaaacacaaaguucaccccugugggagucauucaggauggcucuacaacgcaccgcaaugaaccccagcaaugggugcugcccagcuacuccggcagaaacguucagaaugugcaccuugccccugcggucgcuccgaccuuucccggggagcagcuccuguucuuucggagcacaaugccuggauguucuggcuaucccaacauggaccuggauugccugcucccucaggagugggugcaacauuucuaccaggaagccgcccccgcucaguccgacguggcccugcuucgcuuuguuaauccugauaccgggagaguccuguucgaguguaaacuccacaagagcggauaugugacaguggcucauaccggccagcacgaccuggucauucccccgaacggguacuuucgguucgauucuugggugaaccaauucuauacgcuugccccuaugggcaauggaaccggcagacgccgggcgcuguga

SEQ ID NO: 28779 - RNA, 1593 nt, Artificial Sequence
  derived and/or modified sequence opt5 from major_viral_capsid_protein__Norovirus__AFN09975
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccucgcuuugaauccagaaccaaaccguucagcguccccgugcucacgguugaggaaaugaccaauucucgguuuccuauuccccuggagaaacuuuucacagggccuuccagcgccuuugugguccagccccagaacggacgcuguaccacagauggcgugcugcucgggaccacgcaacugucuccgguuaauaucugcacauucagaggagacgugacccauauuccuggcucccggaacuacacaaugaaucuggccagccagaacuggaacuccuauggccccaccgaggaaaucccugcuccccucgggaccccugauuucgucggaaagauccagggcgugcugacacagacgacccgcacaaaugggucuaccagaggacacaaggcgacagucuacaccggcagcgccgacuuuucccccaaacuugggcgggugcaauucgcuacggauacagacaaugacuuugagaccaaccagaauaccaaguucacaccgguuggagugauucaggauggcagcaccacaccucgcaacgaaccccaacaguggguccugcccucuuacuccggcagaaauauccauaacgugcaccucgccccugccguugcuccgacguuucccggggagcagcugcuuuucuuucggagcaccaugccuggauguucuggcuaucccaauauggaccuggauugccuccugccucaggaaugggugcaauacuucuaucaggaggccgcgcccgcucagagcgacgucgcccugcucagauuugugaacccugauacagggcgcgugcuguucgaguguaaacuucacaaguccggauacguuaccgucgcccauacaggccagcacgaccuggugauucccccgaacggguauuuucgguucgauucuugggugaaucaauuuuacacccucgcuccuaugggcaacggaacgggcagacgccgggcccuguga

SEQ ID NO: 28780 - RNA, 1623 nt, Artificial Sequence
  derived and/or modified sequence opt5 from major_viral_capsid_protein__Norovirus__AFN09978
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccugcggcgaauuuacaguguccccucggaaugcccccggggagauucuguggucugcgccucuuggaccggaucugaaccccuaccucagccaccuggcccgcauguauaauggcuacgcugggggauucgaaguccaggugauccuugccggcaacgcuuuuacggccggcaaaauuaucuucgcggccguuccucccaauuuuccuaccgaggggcugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggagaugacguuuucaccgugagcuguagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccggcccguccagcgccuucgugguucagccucagaacgggcggugcacaaccgauggagugcuccugggcacgacacaacugucucccgucaauauuuguaccuuucgcggggacgugacacauaucccuggauccagaaacuacaccaugaaucucgccagccagaacuggaacuccuaugaucccaccgaggaaaucccugcuccccugggcacaccggacuucgucggcaaaauucagggggugcuuacgcagaccacacggaccaauggaucuacacgcggccacaaggcgaccguuuacacggggagcgccgacuuuuccccuaagcugggaagagugcaauucgcuacagauaccgacaaugauuuugagaccaaccagaauacaaaauucacccccgucggcgugauccaggacgggagcacaacgccccggaacgaaccucaacaguggguucucccgucuuacuccggacgcaauauucauaacgugcaccuggcccccgccgucgcuccuaccuuucccggcgagcagcuucuguucuuuagaagcacaaugccuggcugcucuggguaucccaauauggaucucgacugucugcugccucaggaaugggugcaauacuucuaucaggaggccgcgcccgcucagagcgauguggcccuccugcgguuuguuaacccggacaccggaagaguccuuuucgagugcaagcugcacaaauccggcuacgugacaguggcccauaccgggcagcacgaucucgucaucccucccaacggauauuuucgcuucgacucuugggugaaucaauucuacacgcuggcuccuaugggcaacgggaccggccggagacgcgcccuuuga

SEQ ID NO: 28781 - RNA, 1623 nt, Artificial Sequence
  derived and/or modified sequence opt5 from major_viral_capsid_protein__Norovirus__AFN09981
augaagauggccagcaacgacgugaaucccuccgauggcucugcugccaaccuggucccugagguuaauaacgaagugauggcgcucgagccgguggucggggcugccaucgccgcucccguggccggacagcaaaauguuauugacccuuggaucagaaacaauuucgugcaggcucccggcggggaauuuaccgucagcccucggaacgcccccggagagauucugugguccgcgccucuuggcccggaucugaaucccuaccucucucaccuggcccgcauguauaacggguacgcuggaggcuucgaagugcagguuauccuugccggcaaugcuuuuacagccgggaaaauuaucuucgcggccgugccucccaacuuuccuacggagggacugagccccucccaggucaccauguucccgcauaucauuguggacgugagacaacucgagccuguccugaucccccugccugauguucggaauaacuuuuaucacuacaaucagucuaacgacagcacaauuaagcucaucgcuaugcuguauacaccccuucgcgccaacaaugcuggcgaagauguguucaccguguccugcagaguccugacccggcccagcccugacuuugauuucauuuuucucgugccgcccacaguugagucucgcaccaaaccuuucacggugcccauccugaccgucgaagagaugacaaacuccagauuuccuauuccccuugagaagcuguucaccgggccgagcucugccuucgugguucagccucagaauggacgguguacaaccgacggcgugcuccuggggacgacacaacugucccccgucaacaucugcaccuuucgcggagaugugacacauaucgccggcagcagaaauuacaccaugaaccucgcuucucugaauuggaacaauuaugacccuaccgaagagauucccgcgccucuuggcacacccgauuucgucgggaaaauccagggagugcugacgcagaccacaaagggcgacggguccacccggggacacaaggccacaguuuacaccggcagcgcuccguuuacgccuaaacucggguccgugcaguucucuacagacaccgaaaacgauuuugagacccaucaaaauacaaaguucacccccgucggagugauucaggacggcggcacaacgcaccgcaacgaaccccagcaauggguucugccuagcuacuccgggagagaugugccgaauguccaccuugcccccgccguggcuccuaccuuucccggagagcagcuccuguucuuucggagcacaaugccuggcuguucuggguaucccaacauggaccuggauugccugcucccucaggagugggugcagcauuucuaccaagaagccgcgcccgcucaguccgacguugcccugcuucgcuuugucaauccggauaccggaagagugcuguucgaguguaaacuccacaagagcggcuaugugacagucgcccauaccgggcagcacgaccuggugaucccucccaacggcuacuuucgguucgauucuuggguuaaccaguucuauacgcuugcuccuaugggaaauggcaccgggagacgccgggcccuguga

SEQ ID NO: 28782 - RNA, 1623 nt, Artificial Sequence
  derived and/or modified sequence opt5 from major_viral_capsid_protein__Norovirus__AFN09984
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagagucauguucgaguguaaacuucacaaguccggguacgugacaguggcccauaccggacagcacgaucuggucaucccucccaacggcuauuuucgcuucgacucuugggugaaucaauucuacacgcucgcuccuauggggaacggcaccggacggagacgcgcccuguga

SEQ ID NO: 28783 - RNA, 1623 nt, Artificial Sequence; identical to SEQ ID NO: 26522
  derived and/or modified sequence opt5 from major_viral_capsid_protein__Norovirus__AFN09987

SEQ ID NO: 28784 - RNA, 1623 nt, Artificial Sequence; identical to SEQ ID NO: 26522
  derived and/or modified sequence opt5 from major_viral_capsid_protein__Norovirus__AFN09990

SEQ ID NO: 28785 - RNA, 1623 nt, Artificial Sequence
  derived and/or modified sequence opt5 from major_viral_capsid_protein__Norovirus__AFN09993
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacgaucgguguacaaccgacggagugcuccugggcacgacacaacugagcccugucaauauuugcaccuuucgcggggaugugacacauauccccggaucuagaaacuacaccaugaaucucgccucccagaacuggaauagcuaugacccuaccgaggaaauccccgcuccgcugggcacaccugacuucgucggcaaaauucagggggugcuuacgcagaccacacggaccaacggauccacacgcggccacaaggcgaccguuuacacggggucugccgauuuuagccccaagcugggaagagugcaauucgcuacagacaccgauaaugacuuugagaccaaccagaauacaaaauucacccccgucggcgugauccaggauggguccacaacgccucggaacgaaccgcaacaguggguucuccccagcuacucuggacgcaauauucauuccgugcaccuggccccugccgucgcucccaccuuuccuggcgagcagcuucuguucuuuagaagcacaaugcccggcuguucuggguauccuaacauggaccucgauugccugcugccccaggaaugggugcaauacuucuaucaggaggccgcgccggcucagagcgacguggcccuccugcgguuuguuaauccugauaccggaagaguccuuuucgaguguaagcugcacaaauccggcuacgugacaguggcccauaccgggcagcacgaccucgucauucccccuaacggauauuuucgcuucgauucuugggugaaccaauucuacacgcuggcucccaugggcaaugggaccggccggagacgcgcccuuuga

SEQ ID NO: 28786 - RNA, 1623 nt, Artificial Sequence; identical to SEQ ID NO: 26522
  derived and/or modified sequence opt5 from major_viral_capsid_protein__Norovirus__AFN09996

SEQ ID NO: 28787 - RNA, 1623 nt, Artificial Sequence; identical to SEQ ID NO: 27746
  derived and/or modified sequence opt5 from major_viral_capsid_protein__Norovirus__AFN09999

SEQ ID NO: 28788 - RNA, 1623 nt, Artificial Sequence
  derived and/or modified sequence opt5 from major_viral_capsid_protein__Norovirus__AGC96529
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagagauaucccgaaugugcaccuugcccccgcuguugccccuaccuuucccggggagcagcuccuguucuuucggucuacaaugccuggauguuccggcuaucccaacauggaccuggauugccugcucccucaggagugggugcagcauuucuaccaagaagcggcucccgcccagagcgacgucgcccugcuucgcuuugugaauccggauaccgggagagugcuguucgaguguaaacuccacaagucuggauauguuacagucgcucauaccggccagcacgaccuggugauuccucccaacggguacuuucgguucgauagcugggugaaccaguucuauacgcuugccccuaugggcaauggaaccggcagacgccgggcucuguga

SEQ ID NO: 28789 - RNA, 1623 nt, Artificial Sequence
  derived and/or modified sequence opt5 from major_viral_capsid_protein__Norovirus__AGC96532
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaccccugcuccccugggcacgccggacuucgucgggaaaauccagggagugcuuacccagacaacccggacaaauggcucuacccgcgggcacaaggcgacgguuuacacaggaagcgccgacuuuuccccuaagcugggcagagugcaauucgcuaccgauaccgacaaugauuuugagacaaaccagaauaccaaauucacacccgucggggugauucaggacggaagcacgacaccccggaacgaaccucaacaguggguucucccgucuuacuccggccgcaauauccauaacgugcaccuggcccccgccgucgcuccuacauuucccggcgagcagcuucuguucuuuagaagcaccaugccuggguguucuggauaucccaauauggaucucgacugccugcugccucaggaaugggugcaauacuucuaucaggaggccgcgcccgcucagagcgauguggcccuccugcgguuuguuaacccggacacaggcagaguccuuuucgaguguaagcugcacaaauccggguacgugaccguggcccauacgggacagcacgaucucgucauuccucccaacggcuauuuucgcuucgacucuugggugaaucaauucuacacccuggcuccuauggggaacggcacaggacggagacgcgcccuuuga

SEQ ID NO: 28790 - RNA, 1644 nt, Artificial Sequence
  derived and/or modified sequence opt5 from major_viral_capsid_protein__Norovirus__AGC96535
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaagauacccccagaaugcggcuuguugcuaugcuguacacaccucuccgcgccaauucuggggaggacguguuuaccgugagcuguagaguccugacacggcccgcucccgauuucgaguuuaccuuccuugugccuccgacaguugaauccaagaccaaacccuuuacgcugccuauucucacccugggagagcugagcaacucucgcuuccccgccccuaucgacaugcucuauacagaucccaacgaaaccauugugguccaaccgcagaauggcagaugcacacuggacgggacccuucagggaacgacacagcuggugccuacccaaaucuguuccuuucggggcacacucauuagccagaccucucgcuccgccgauagcaccgacucugcucccagaguucggaaccacccucugcaugugcagcuuaagaaucuggaugggacacccuacgacccuacggacgagguccccgcggugcucggagccaucgauuucaaaggcaccgucuucggcguggcuucccaacgcaacacaaccgggagcuccguuggagccacaagagcccacgaagugcacaucgacaccacgaauccgcgguauacaccuaagcugggcucuguccugaugcauagcgaguccagcgauuuugacgaugggcagcccaccagauucacccccauuggaaugggcgcugacgauuggcaccagugggagcucccugaauacucugggcaucugacacuuaacaugaaucuggccccggcgguggcucccgccuuuccuggagagcgcauccucuucuuucgguccguugugcccagcgccggcggcuacgggucuggacagauugacugccugaucccucaagaauggguccagcacuucuaucaggaggcugcccccagccaguccgcuguggcccuuauuagauacgugaacccugauaccggccgcaauaucuuugaagcgaagcugcaccgggagggguucaucacaguugccaacucuggaaauaaccccauugucgugccgccuaauggcuauuuuagauucgaggcuugggugaaccaauuuuacacgcucacccccauggggacaggccagggacgccggagaguccaguga

SEQ ID NO: 28791 - RNA, 1623 nt, Artificial Sequence
  derived and/or modified sequence opt5 from major_viral_capsid_protein__Norovirus__AGS16690
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuaauuacagcggguccgauguuccgaacgugcaccuugcccccgcugucgccccuaauuuucccggagagcagcuccuguucuuuagaagcaccaugccuggcuguucuggguaucccaacauggaccuggauugccugcucccucaggagugggugcagcauuucuaccaagaagcggcucccgcccaguccgacguggcccugcuucgguuuguuaacccggauacaggacgcguccuguucgaguguaaacuccacaagagcggcuaugugaccguggcucauacagggcagcacgaccuggucaucccucccaauggcuacuuuagauucgauucuugggugaaccaguucuauacccuugccccuaugggaaauggcacggggcggagacgcgcucuguga

SEQ ID NO: 28792 - RNA, 1623 nt, Artificial Sequence; identical to SEQ ID NO: 28791
  derived and/or modified sequence opt5 from major_viral_capsid_protein__Norovirus__AGS16693

SEQ ID NO: 28793 - RNA, 1623 nt, Artificial Sequence; identical to SEQ ID NO: 27460
  derived and/or modified sequence opt5 from major_viral_capsid_protein__Norovirus__ALM98919

SEQ ID NO: 28794 - RNA, 1623 nt, Artificial Sequence; identical to SEQ ID NO: 27460
  derived and/or modified sequence opt5 from major_viral_capsid_protein__Norovirus__ALM98922

SEQ ID NO: 28795 - RNA, 1623 nt, Artificial Sequence; identical to SEQ ID NO: 27460
  derived and/or modified sequence opt5 from major_viral_capsid_protein__Norovirus__ALM98928

SEQ ID NO: 28796 - RNA, 1623 nt, Artificial Sequence; identical to SEQ ID NO: 27460
  derived and/or modified sequence opt5 from major_viral_capsid_protein__Norovirus__ALM98931

SEQ ID NO: 28797 - RNA, 1623 nt, Artificial Sequence; identical to SEQ ID NO: 26819
  derived and/or modified sequence opt5 from major_viral_capsid_protein__Norovirus__ALM98934

SEQ ID NO: 28798 - RNA, 1623 nt, Artificial Sequence
  derived and/or modified sequence opt5 from major_viral_capsid_protein__Norovirus__ALM98940
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucguggauugucugaucccucaagaguggauucagcauuuuuaucaggaauccgcccccagccagucugacguugcucucaucagauacgugaauccggauacagggcggacccuguucgaggccaagcugcacagaagcggauauauuaccgucgcgcacuccggcgacuacccucugguggugcccgcuaacgggcauuuucgcuucgacucuuggguuaaucaauucuauagccucgccccuaugggcacaggaaacggccggagacgcgcccaguga

SEQ ID NO: 28799 - RNA, 1623 nt, Artificial Sequence; identical to SEQ ID NO: 27460
  derived and/or modified sequence opt5 from major_viral_capsid_protein__Norovirus__ALM98943

SEQ ID NO: 28800 - RNA, 1623 nt, Artificial Sequence
  derived and/or modified sequence opt5 from putative_capsid_protein__Norovirus__ABD73936
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcaugucaucguggacgugagacaacucgagccuguccugauuccccugccugauguucggaauaacuuuuaucacuacaaucagucuaacgaccccaccaucaagcucauugcuaugcuguauacaccccuucgcgccaacaaugcuggcgaagauguguucaccgugagcugcagaguccugacacggccuuccccggacuuugauuucaucuuucucgugcccccuaccguugagagccgcacgaaacccuucaccgugccuauucugacagucgaagagaugaccaacucuagauuucccaucccgcuugagaagcuguucacagggccuuccggagccuucgugguucagccccagaauggccgguguaccacggacggggugcuccugggaacaacccaacugagcccugucaacauuugcacauuucgcggcgaugugacccauaucgccggcacccacaauuacacaaugaaccucgcuucucagaauuggaacaauuaugaccccacggaagagaucccugcgccccuggggaccccggauuucgucggacggauucagggcaugcuuacacagaccacaagaggggacggauccacccgcggccauaaagccacggugagcacaggggacguucacuuuaccccuaagcugggaucuauccaauucaacaccgauacaaauaacgacuuugaaaccggccagaauacaaaguucacgcccgugggcgucgugcaggaugggaacggaacccaccaaaaugagccccagcaguggguucucccuuccuacagcggcagaacagggcauaacgugcaccuggcuccggccgucgcccccaccuuuccuggagaacagcuucuguucuuucgguccacaaugcccggcuguucuggguacccuaacaugaaucucgacugccugcugccccaagagugggugcagcauuucuaucaggaggcugccccugcgcagagcgauguggcucuccugcgcuuuguuaaccccgacaccggcagaguccuuuucgaauguaaacugcacaaguccggauacgugacgguggcccacaccggccaacaugaucucgucauuccgccuaauggguauuuucgguucgacagcugggugaaccaguucuacacacuggcccccaugggaaauggcaccgggagacgccgggcucuuuga

SEQ ID NO: 28801 - RNA, 1560 nt, Artificial Sequence
  derived and/or modified sequence opt5 from structural_capsid_protein__Norovirus__ABY67257
augaagaugaccgacaaagauacacaggaggccgcucccgcccugggccaagugcucccuccggaagucgagguugcgauccccguggaaccuacggcuggggcccagauugccgcucccaccgccggacaggugaacccuaucgaccccuggauuuucgcuaauuuuguccaggccccucaaggcgaguucacaaucagcccgaacaauaaccccggggaagugcuguuugagcuugagcugggaccugaacucaaucccuaccuggcgcaccuuagacagauguauaacggcuggaccggguccauucggguuaaggugauccuggccggaaaugcuuucucugccggcaaaaucauugucuuuugcaucccucccggcuucgaugcuagcuaccucacaccguuucaggccacccaguucccucaugugauuauggacguucgcgcggccgagcccaucgaaauuccucuggcugaugugagaaacguccuguuucaccaagggcccgacucccggaugcgccucaugggaaugcuguauacaccccuuagagccaauucuggcgcugauccuuucguggugaccgggcggguccugacguguccgagccccgacuuuuccuucuuuuuccucguuccucccaccguggaggagcgcucuacaccuuucagcgugcccaacgucccgguguacucccugaccaauagcagagccccuguucccaucuaugaacuucggucuucccgcagccugccucucacagugcaguuucagaacggaagaugcaccgucgagggcgaucugcuggggacgacacccuucucugccggagaccucuguuccuuuaugugcauucggggcgauacccagcauaucgcugaacugcuugagccugacgaaagcgcguucgugguuggcgagcgccccgccacacugggguuuccggauuucucucaaugugugcuccaccuucuucuggcugacggaaccggcaucuggcaucagucccucgacgucaagaauccucagcacuuuacccccgccauugggcaagugguccugagcggagaugugccccugacaagaacgcggguucgccucgacuacgugcuguccaccucuagagauagcuucuggguccuuccugacuaucgguccgaugugcugggcagcgaguuugccccggcuguuucugcccccggggugggagaaacacuccuguucuuuaugggcagagcgccuguccagggccccuccaacccucuucccugccugcucccucuggaguggguguuccacuuugcuagcgaacgccccaccaaacagucugacguggcccugcucaauuacguuaacccggauacagggcggguccuguucgaggccaagcuguacagcuccggauuccugaccgugaaccucggcacggcuaaugaagugguccugccuacaucugggaucuuuaaguucgccagcugggugucccuguauuaccagcuuagacccguuggaacccucagcgcuggccgccggcugccuagaguggacggguauuga

SEQ ID NO: 28802 - RNA, 1653 nt, Artificial Sequence
  derived and/or modified sequence opt5 from viral_capsid_protein__Norovirus__AHA91656
augaugauggccagcaaggacgcuaccuccaacauggauggcacaucuggggccggacagcuggugcccgagaauaacaauacgagcgaaccuaucaacauggagccggucgcgggcgcuguuaccgccgccgcuacagccgggcaagugaauaugauugaccccuggaucaugaacaauuacgugcaggcuccucagggagaguucaccauuucccccaacaauacaccuggcgauauccucuuugaccugcagcuugggccccaccugaacccuuuccucgcccaucugucucaaauguauaauggaugggucggcaacaugaaagugagaguugugcuugcgggcaaugccuuuagcgcugggaagauuaucgucugcuguaucccgcccggauucuccgccccuaacauuucuaucgcucaggccaccauguuuccccacgugauugcggauguucgggugcuggaaccuaucgacauuccccucgaugacguccgcaaugugcuguuccauaacaacgauaauggcaaccagacaaugagacugcucugcaugcuguacaccccgcuucggagcgggggaacguccagcggcaccgacccuuuugugaucgccgggcgcguccugacaugucccaccccugauuucaauuuucucuuccugguuccucccacaguggaacagaaaaccaagcaauuuucugugcccaaccuuccgcugaaugucauguccaacagcagagugcccucucuccugaaugcuaugguuguguccccugaccaggcccaggucgugcaguuccaaaacggacggugcacgcuggauggccagaugcucggcacaaccacaguuagcgcuucuuguguggcccgcuuuagagggaaaaccuuccaggcccccgacaaucggcugggaauuaaccuugcugagaucuccggcgagccuuaucacgcguucgaaagccccgccccgcugggguuuccugacuucggagauggcgacuggcaugucaccgcuacaaaggugacgcccucccaacucgaggccaaugauccugucgugauggggaacguucagcccuacaauccucaguuugcuccccaccugggaacccuuguggucgaaaacccgacaccugacaaugugaccacaggcaccgaucuccuguucaacaucacguggcugucuaaccgcgccaauaacagauuuaaucccuggguuauucccaacuauggcagcacacugaccgaggccgcgcagcucgcuccuuccaucuucccgcccggguuuggagagaccauuguguacuucaauagcacauuuccugccgucggcgccaccacacacgcugccauccccugccugcuuccucaagaguucguggcucauuuugugaacgaacaggcccccauucgcggggaagcggcccugcuccacuauaucgacccugauacgcaucggaaucugggagaguucaagaucuaccccgaaggcuuuguuaccugugucccgaacgucgggggcacaggaccucagucucuucccaccaauggcauuuucguguucguguccugggugagcagauacuaucagcugaaaccuguugggacagcuggacaagcccggcgccucggcuuuagacggguguga

SEQ ID NO: 28803 - RNA, 1629 nt, Artificial Sequence; identical to SEQ ID NO: 26867
  derived and/or modified sequence opt5 from VP1_capsid_protein__Norovirus__BAL60747

SEQ ID NO: 28804 - RNA, 1629 nt, Artificial Sequence; identical to SEQ ID NO: 26868
  derived and/or modified sequence opt5 from VP1_capsid_protein__Norovirus__BAL60751

SEQ ID NO: 28805 - RNA, 1629 nt, Artificial Sequence; identical to SEQ ID NO: 26875
  derived and/or modified sequence opt5 from VP1_capsid_protein__Norovirus__BAL60763

SEQ ID NO: 28806 - RNA, 1629 nt, Artificial Sequence; identical to SEQ ID NO: 26878
  derived and/or modified sequence opt5 from VP1_capsid_protein__Norovirus__BAL60765

SEQ ID NO: 28807 - RNA, 1629 nt, Artificial Sequence; identical to SEQ ID NO: 26889
  derived and/or modified sequence opt5 from VP1_capsid_protein__Norovirus__BAL60787

SEQ ID NO: 28808 - RNA, 1629 nt, Artificial Sequence; identical to SEQ ID NO: 26890
  derived and/or modified sequence opt5 from VP1_capsid_protein__Norovirus__BAL60789

SEQ ID NO: 28809 - RNA, 1629 nt, Artificial Sequence; identical to SEQ ID NO: 26901
  derived and/or modified sequence opt5 from VP1_capsid_protein__Norovirus__BAL60807

SEQ ID NO: 28810 - RNA, 390 nt, Artificial Sequence
  derived and/or modified sequence opt5 from capsid__Norovirus__ACL14997
auggccagcaacgacgcugcccccuccaaugauggcgcggcugggcuggugccugagucuaacaaugaagucauggcccucgagccgguugccggagcuagccuggccgcucccgugaccggccagacaaacaucauugacccuuggaucagaaugaauuucgugcaagcccccaacggggaauuuacggucuccccucgcaauucucccggagaggugcuucugaaccucgaacugggcccugagcuuaauccguaccuggcgcaccucagccggauguauaacggguacgccggaggcauggagguucagauuaugcuggcuggcaaugccuucaccgcugggaagcugaucuuugccgcggugcccccuuauaacagacggugcuga

SEQ ID NO: 28811 - RNA, 561 nt, Artificial Sequence
  derived and/or modified sequence opt5 from truncated_capsid_protein__Norovirus__ACB56490
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugaugcaacucgagccugugcugaucccccugccugaugucagaaauaacuuuuaucacuacaaucagucuaacgacagcacaauuaaguucgauuccaacgccguuuauaccacauga

SEQ ID NO: 28812 - RNA, 627 nt, Artificial Sequence
  derived and/or modified sequence opt5 from truncated_capsid_protein__Norovirus__ACF77106
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccauuagcuga

SEQ ID NO: 28813 - RNA, 627 nt, Artificial Sequence
  derived and/or modified sequence opt5 from truncated_capsid_protein__Norovirus__ACF77107
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccuuga

SEQ ID NO: 28814 - RNA, 66 nt, Artificial Sequence
  derived and/or modified sequence opt5 from truncated_capsid_protein__Norovirus__ACU28807
augaagauggccagcaacgacgcucaccccuccgauggcucugccgcgaccagcucccagagauga

SEQ ID NO: 28815 - RNA, 312 nt, Artificial Sequence
  derived and/or modified sequence opt5 from truncated_capsid_protein__Norovirus__ACU28808
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggccuuuga

SEQ ID NO: 28816 - RNA, 123 nt, Artificial Sequence
  derived and/or modified sequence opt5 from truncated_capsid_protein__Norovirus__ACV03476
augaagauggccagcaugacccccacacaccugaugggcccucagccgacguccucucaaagaagcaccaugcggcucuggcuguggucuccccuuuccgugccucugcuccgcagacuguga

SEQ ID NO: 28817 - RNA, 87 nt, Artificial Sequence
  derived and/or modified sequence opt5 from truncated_capsid_protein__Norovirus__ACV03479
augaagauggccagcaugacaccccugcaccucaugauggugccuccggcuuccucucagagaagcaccaugcggcaauggcgcuga

SEQ ID NO: 28818 - RNA, 1623 nt, Artificial Sequence
  derived and/or modified sequence opt5 from capsid_protein__Norovirus__AFN70960.1
augaagauggccagcaaagacgcuaaccccuccgauggcucuaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacagugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuacggccgggaagguuauuuucgcggccgugccucccaauuuuccuaccgagggacugagccccucccaggucacaauguucccgcauaucgugguggacgucagacaacucgagccuguucugaucccccugccugaugugcggaacaauuuuuaucacuacaaccagucuaaugaccccaccauuaaacucaucgcuaugcuguauacaccccuucgcgccaacaacgcuggcgaagauguguucaccgucagcugcagagugcugacacggccuuccccggacuuugauuucauuuuucucguucccccuaccguggagagccgcacgaagcccuucaccgucccuauccugacaguggaagagaugaccaauucuagauuucccauuccgcuugagaaacuguucacagggccuuccggagccuucguugugcagccccagaacggccgguguaccacggacgggguccuccugggaacaacccaacugagcccugugaauaucugcacauuucgcggcgaugucacccauauugccggcacccacaacuacacaaugaaucucgcuucucagaacuggaauaacuaugaccccacggaagagaucccugcgccccuggggaccccggauuucgugggaagaauccagggcaugcuuacacagaccacacgcggggacggauccacccggggccauaaggccacgguuagcacaggggacgugcacuuuaccccuaagcugggaucuauucaauucaauaccgauacaaacaaugacuuugaaaccggccagaacacaaaauucacgcccgucggcgugguucaggaugggaauggaacccaccaaaacgagccccagcagugggugcucccuuccuacagcggcagaacagggcauaauguccaccuggcuccggccguggcccccaccuuuccuggagaacagcuucuguucuuucgguccacaaugcccggcuguucuggguacccuaacaugaaccucgacugccugcugccccaagagugggugcagcauuucuaucaggaggcugccccugcgcagagcgauguugcucuccugcgcuuugucaaucccgacaccggcagagugcuuuucgaauguaagcugcacaaauccggauacgugacggucgcccacaccggccaacaugaucucgugaucccgccuaacggguauuuucgguucgacagcuggguuaaucaguucuacacacuggcuccccuuggaaacggcaccgggagacgccgggcccuguga

SEQ ID NO: 28819 - RNA, 1629 nt, Artificial Sequence
  derived and/or modified sequence opt5 from VP1__Norovirus_and/or_Norovirus-like__X81879
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagaagauuaccauguuuccccacgugaucauugaugucagaacacuggagccggugcuucugccucuccccgacgugcggaacucuuucuuucauuauaaucagaaagaugacccuaagaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaaaacaaagccuuuuacccugcccauccugacacucggggagcugagcaauucuagauucccuguucccauugaucaaauguacaccuccccgaacgaggugaucagcguccagugucagaacggacggugcacgcuugacggcgaacugcaggggacaacccaacuccaggugucuggaauuugugccuuuaagggcgagguuacagcucaucugcacgauaaugaccaccuuaacaaugugaccaucaccaaccugaauggcuccccuuucgaccccagcgaagauauuccugcgccccucggggucccugacuuccagggacgcguguuuggcgucaucucucagagagauaaacaaaacgccgcugggcacuccgagcccgccaaucggggacaugacgccgugguuccgacauauacggcucaguacaccccuaagcugggccagauucaaaucgggacauggcagaccgaugaccugacagugaaccagcccgucaaauucacccccgugggacucaaugauacggaacacuuuaaccaguggguugugccucgcuacgccggcgcgcugaaucuuaacacaaaucuggcuccgagcgucgcccccguguucccuggcgagagacuccuguuuuuccggucccaucuuccccugaaagggggauauggcaacccugccaucgacugccuccugccccaagagugggugcagcacuuuuaccaggaagcugccccuucuaugagcgagguugcucugguccgcuauauuaaucccgauaccgggagagcccucuucgaagcgaagcugcaccgggccggauuuaugaccguguccagcaacacaucugcuccgguggucgugccugccaacggcuacuucagauuugacuccuggguuaaucaguucuauagccuugcucccauggggaccggcaacggacgccggagagugcaauga

SEQ ID NO: 28820 - RNA, 1728 nt, Artificial Sequence
  derived and/or modified sequence opt5 from VP1__Norovirus_and/or_Norovirus-like__FJ875027
augaagauggccagcaacgacgcugcgcccccuuccucugauggcgccgcuaaucuggugccggagaucaacaaugaagucauggcccucgagcccguugccggggcucagcuggccgcuccuguggccggacaauucaacgcgauugaccccuggaucagacagaauuuugugcaggccccugaaggcgaguucaccgucagcccccggaacgcuccuggggaaauucuucugaaucucgagcugggaccgcaccuuaaccccuuucugcagcaucucgcccaaauguacaaugcuuaugccggcgggauggaggugcagguugugcuggcgggaaacgccuucacagcuggcaaaaucauuuuugccgcuaucccuccccacuucccucccgaacgccuguccgccgcccaggcuacgcaguuuccgcaugucaucguggauguuagacaacucgagccuauugugcugccccuuccugacguccggcacaaucuguuccauuuuaaccagcagaaugaugaacgcaugcaccucguggcguuccuguacacaccccuuagagccaacucuggcaauggggacgauguguuuaccgucagcugccggguucugacccgccccucccaggacuucgaguuuauguuccucgugccuccgacaguggagaagaaaaccgucgcuuucucucugccccaacuggccgugggagaaaugagcaacuccagauggccugcccggaucacaggcaugguuguggauccccgccucccucagguccugcacauucagaacgggagauguacccuugacggaacgcugaugggcaccacacaacucaaucccaacgauaucugccggauucgcggguauuuuucuagcuccagaccggagcugcuuugugaaggagaggaaagcgaggugaauaccacaccuaccgacucuggcgcuacgggcgaucagacacccgagguucggaccgggacacgcgccacccagagaugguucgcggugaccgaacugaacggacaggucuacgacccuuuuggcgaccaacccgcuccucucggggugcccgauuucaaggcccggauccugggagcccugaugagacucccgggcacaaauccuacguccaacagccgcuuugaggacgcuugggucgaaaccaauaaccagacaaccuaugcccccgcuacaggggugguugccauuaccacgaaugauaacucuuccggaaauuacgcgaacgaccagacaugcgaguucgugccccugggcaucgaaaucaccgauagcgccccuuauaaugaguuugaccuuccguccuacggcggggcugccucuagcggaaaccggaaucuggcucccaccgucgccccuacauuccccggcgaggcgauucuccuguuuggguccaacaugccuguguacaacagaagcucuggaaccgauaauaaagacauccgcugucuucugcccaacgaauauguucagcaucucuacgauacacaagccccuucccugagcgacguggcucugguccgguaugugaauagagauacgggccgcguucucuucgaggccaagcugcaccgggacggguuuaugaccgugaacgcuucuagcacaaccguccuucccguggacggcuacuucagauuugauuccugggugaaucaguucuaugcccugucuccggucggaaacgccagcggccgccgguga

SEQ ID NO: 28821 - RNA, 1725 nt, Artificial Sequence
  derived and/or modified sequence opt5 from VP1__Norovirus_and/or_Norovirus-like__JF939046
augaagauggccagcaacgacgcugccucccccucuagcgauggcgcggcuaaucuggugccugagaucaacaaugaagucauggcccucgagccgguugccggggcucagcuggccgcucccguggccggacaauucaacgcgauugacccuuggaucagacagaauuuugugcaggcccccgaaggcgaguucaccgucuccccucggaacgcucccggggaaauucuucugaaucucgagcugggaccucaccuuaacccguuucugcagcaucucgcccaaauguacaaugcuuaugccggcgggauggaggugcagguugugcuggcgggaaacgccuucacagcuggcaagaucauuuuugccgcugugcccccucacuuucccccugaacgccugucugccgcccaggcuacgcaguucccccaugucaucguugaugugagacaacucgagccgaucauucugccucuucccgacguccggcacaaucuguuccauuuuaaccagcagaaugaugaacgcaugcaccucguggcguuccuguacaccccucuuagagccaacagcggcuccggggacgauguguuuacagucucuugccggguucugacccgccccagccaggacuucgaguuuauguuccucgugcccccuacaguggagaagaaaaccgucgcuuucucccugccgcaacuggccaucggagaaaugagcaauucuagauggcccgcccggauuacaggccucgugguugauccucgccugccccaggugcuucacauccagaacgggagauguacccuggacggaacgcucaugggcaccacacaacugaacccuaaugauauuugccggauccgcggguauuuuuccagcucuagacccgagcuucugugugaaaacgaggaauccgcuaccgacccgaugccuacagagaccgauacggacaaucagcccccugagguccgggcccaggcgcgcgcuacacagagaugguucgccgugaccgaacucaacggacaaguuuacgaccccuuuggcgaucagccugcuccccugggcgugccggacuucaaggcccggauucugggggcccucaugagacugccuggaacaaaucccaccagcaacucucgcuuugaggaugcuugggucgaaaccaauaaccagacaacguaugcccccgcggccggcguggucgcuaucaccacaaaugacaacuccagcuccaauuacgccaacgaucagaccugcgaguucgugccucuugggaucgaaauuacagacucugcuccguaucaugaguuugaucugcccagcuacggaggcgccgcguccagcgggaaucggaaccucgccccuaccguugcucccacguucccuggagaggccauccugcuuuuuggcucuaauaugcccguguacaacagaaacacaggcaccuccaauaaagacauucgcugucugcucccuaacgaauauguccaacaccuguacgauacccaggcucccagccugucugacguggcccucguucgguaugugaauagagauacagggcgcguccuguucgaggccaaacuucaucgggacggauuuaugaccgugaacgcuagcuccacaacggugcugccgguugacggcuacuucagauuugauucuugggucaaucaguucuaugcgcucagcccuguggggaacgccuccggacgccgguga

SEQ ID NO: 28822 - RNA, 1722 nt, Artificial Sequence
  derived and/or modified sequence opt5 from VP1__Norovirus_and/or_Norovirus-like__JF930689
augaagauggccagcaacgacgcuaccgcccccucccaggauggcgcggcuaaucuggugccugaaucucaacacgaaguccucgcccuggagccgguugccggggcugcccuugcugcccccguggcgggacaguucaacgccaucgacccuuggauuaaacagaauuuugugcaggcucccgccggcgaguucacagucagcccuagaaacgcucccggggaaauccugauggaucucgaacugggaccugagcuuaauccguuucuggcccaucucgcgcaaauguacaacgccuaugcuggcgggauggaggugcagauuauccuggccggaaaugcuuucacggccggcaagauuaucguuugcgccgugcccccuaacuuucccccugaccggcuguccgcuucucaggcgaccaauuucccccacgucaucauggaugugcgcacacucgaaccgguuauucugccucuucccgacgugagagccggcuuuuuccauuacaaccagcugcgggagccucgcaugagacucauggcucugcuuuauacaccccugcgggccaaugggaccggagaugacgccuuuaccgucagcugucgcgugcucacaagacccaugcaagauuucgaauuuauguuccuggugccuccgaccgucgagucccggguuacgcccuuuucugugccuaccuaccccguggucgagaugacaaacagccgcuggccugcuagaaucuccggcaugcacgugaaugccaaccagacccuggcgguucaguuccagaaugggcggugcacacucgacggacaacugaugggcaccacgcagcuuugugcugccgaugugugccgcaugagagggcgguauacaagcacccgcgccgaccuggcuggagucgaucauacagaccagggccccucucucggcaccgggccguccgacgauagcgugucuguuccugaagccagagcucaaacccggacaggaguguccgcccaccuccagcuugaggaacugaacggccagcccuacgaggucuauggggaacagccugcgccccucggaacgccugacuucagaugucgccugaugggcgagcuggugcggcuccccagcaccucuccggccgcucaauccagauuucgcgaugccuucuuugacacauacggggcucuguucgccccugcggucggaagcaccacauuuaccgugaacaauuccucuacgagcgauuucgccaacggccagcccuuugaguuccuucccauuggcguugaaaucggaaauuccgcucaguacgacgaguuugcccugccuagcuauaacggggcuauuggcgaaaaucggcaccucgccccgguggccgcucccggguucccuggagagaacaucgucuuuuucucuuccaaucugcccgugugggauagcacaucugcgcagaacaauagacgcauuagcugccuucugccuaacgaauuuguucaacauuucuacgaccuccaggcccccucccagucugauguggcucugcugcgguauguccacccugagagcggcagagugcuguucgaguguaaacuguaccgcgacggguuucuuaccgugaauggcgccucccuggccgaguuccccguuaacggauauuuucgguucgauagcugggucaaucaguuuuucacccucucuccggugggcacaggguccggaagacgcuga

SEQ ID NO: 28823 - RNA, 1719 nt, Artificial Sequence
  derived and/or modified sequence opt5 from VP1__Norovirus_and/or_Norovirus-like__GQ443611
augaagauggccagcaacgacgcuaccgcccccucccaggauggcgcggcuaaucuggugccugaaucucaacacgaaguccucgcccuggagccgguugccggggcugcccuugcugcccccguggcgggacaguucaacgccaucgacccuuggauuaaacagaauuuugugcaggcucccgccggcgaguucacagucagcccuagaaacgcucccggggaaauccugauggaucucgaacugggaccugagcuuuccccguuucuggcccaucucgcgcaaauguacaaugccuaugcuggcgggauggaggugcagauuauccuggccggaaacgcuuucacggccggcaagauuaucguuugcgccgugcccccuaauuuucccccugaccggcugucugcuagccaggcgaccaacuucccccacgucaucauggaugugcgcacacucgaaccgguuauucugccucuucccgacgugagagccggcuuuuuccauuacaaucagcugcgggagccucgcaugagacucauggcucugcuuuauacaccccugcgggccaacgggaccggagaugacgccuuuaccgucuccugucgcgugcucacaagacccaugcaagauuucgaauuuauguuccuggugccuccgaccgucgagucucggguuacgcccuuuagcgugccuaccuaccccguggucgagaugacaaauucccgcuggccugcuagaaucagcggcaugcacgugaacgccaaucagacccuggcgguucaguuccagaacgggcggugcacacucgacggacaacugaugggcaccacgcagcuuugugcugccgaugugugccgcaugagagggcgguauacaucuacccgcgccgaccuggcuggagucgaucauacagaccagggccccucccucggcgccgggccgagcaaugacccugugucuguucccgaagcuagaucccaaacccggaccagcgugucugcccaccuccagcuugaggaacugaacggacagccuuacgaggucuauggcgaacagcccgcgccucucgggacacccgauuucuguugcagacugaugggagagcuggugcgccucccguccacgagcccugccgcucaaucccgguuuagagacgccuucuuugauaccuacggcgcucuguucgcccccgcggucgggucuacaaccuuuacagugaacaauagcuccaccagcgacuucgccaacggacagcccuuugaguuccuuccuauuggcguugaaaucggcaauucugcucaguacgaugaguuugcccugccguccuauaacggggcuauuggagaaaaucgccaccucgcccccguggccgcuccuggcuuccccggggagaacaucgucuuuuucagcucuaaucugccugugugggacagcacguccgcgcagaacaaucggagaauuucuugucuucugcccaacgaauuuguucaacauuucuacgaucuccaggccccuagccaguccgacguggcucugcugcgcuauguccaccccgagagcggacgggugcuguucgagugcaaacuguacagagauggcuuucuuacagugaauggggccucucuggccgaguucccgguuaacggcuauuuucgcuucgacuccugggucaaucaguuuuucacccucagcccugugggaaccggcucugggcgguga

SEQ ID NO: 28824 - RNA, 1719 nt, Artificial Sequence
  derived and/or modified sequence opt5 from VP1__Norovirus_and/or_Norovirus-like__EU224456
augaagauggccagcaacgacgcugcccccuccucugauggcgcggggaaucuggugccugagagccaccaggaaguccucccgcuggcucccguugccggagccgcuaucgccgcuccuguggugggccaacagaacauuaucgaccccuggauuaaagagaauuucguccaggccccucagggggaauuuaccgugucccccaagaacucuccuggagagguucuugugaaucuggaacucagcccgaaacugaaccccuaccuugaucaucuguccaagauguauaaugcguacgccggcgggauggagaucgagauuauccucgcuggaaacgccuucacagcuggcaaaguccugaucgccgcggugccucccaauuuuccuguugaaaacauuucugugagccaagccucccaguucccccacgucaucguggacgugagaacgcuggagccgauucggcucccucugcccgauguccgcaccaacuuuuuccauuauacaaccagagacgaaccuaagaugcggaucguugcuuggcuuuacacaccccugcgcaccaauggcagcggggaugacucuuuuacaguguccggacggauucucaccagacccagcgccgauuucgaguuuucuuuccuggugccuccgacggucgagaccaagacaguguccuuuagcguucccggccuuaccguggaagagaugucuaauucccgcuggccugcucagaucaacgggcuggucgugagaggaaaugaagcccagguugugcacuuccaaaacggccggugcacaaccgaggggaugcuccugggaacgacaacccugaacgucaauagcauuuguggccuccgcggcacauccaucucucaugccagcgugagagaagcucccgcgcuguccgaggagaugccuccccuugaagacgaggucgcccacggggcugccgccaccuaugcugugggacgggccgcggauaccacacuguggauccgcguugaggaaccgaacggccagccuuacgacauuuuuggggaacagcccgcuccucucggaacgcccgauuucaccgccgugaucauuggcacagccaucagaccucggaccgcuagcggggccuaucugcacgacgcuuacgucgacacacgccccggagaugccgacuucaccccgucuacgggcaauacaaaaauugugcuuagaggcgggggauccggccauguuggggagggacacuacuggcaguuuaagccuaucgcgguggagggcgggcccaaccggcccgucuaucaagaauacaaucugccugaguaugccggcccgaccgcuagcaaccauaaucucgcucccccuguggcucccaaaaugccuggagaacugcugcuccuguucgagucugauaugcccgugugggacaacggcagcggguccgccccuacccagaagauccacugccuucugcccaaugauuuuguuacacacuucuuugaccuccaggcgccggcccuggcugaagccgcccuucugagauacguccauccugauucuggacgcacccucuucgaguguaaacuguaucgggagggcuacauggugguggucgcccccagcgggagacuggacuuuccucucgauggauauuuccgcuuugacuccugggugaacgccuucuacguucugagccccgugggcaaugggcaaggccggagauga

SEQ ID NO: 28825 - RNA, 1719 nt, Artificial Sequence
  derived and/or modified sequence opt5 from VP1__Norovirus_and/or_Norovirus-like__EF450827
augaagauggccagcuccgacgcuacccccucuagcgauggcgccgggaaccuggugccugagucccagcaagaaguccucccgcuggcgcccguugcuggagccgcccuugcugccccuguggugggccagcagaauaucauugaccccuggaucaaagagaacuucguccaggcuccucaaggggaauuuacagugucucccaagaauagcccuggagagguucuggugaaccucgaacuguccccgagacuuaaucccuaccugcaccaucucucuaaaauguauaacgccuacgcgggcgggauggaggucgagauuauccuggccggaaaugcuuucacggccggcaaggugcugauugcugccguuccucccaacuuuccuaucgaaaaugugagcgcgucccaggccagccaguucccccacgucaucguggaugugcggacccucgagccgauucgccugccucuucccgacgucagaacaaacuuuuuccauuauaccacacaggaagaaccucggaugcgcaucguugcuuggcuguacacaccccucagaaccaauggcucuggggaugacuccuuuaccgugagcggacggauucugacgcgccccucuccugauuucgaguuuuccuuccuugugccgcccaccgucgaaacaaaaaccgugagcuuuucuguuccuggccuggugguccaagacauguccaacagcagauggcccgcccagaucuccgggcucgugguucggggaaaugaggcucaggugguccacuuccagaacggccgcugcacaaccgaagggaugcugcugggaacgacaacccucaauauuaacucuaucuguggccugagaggccuuagcgugucccaagccagcguccgcggggccccugcucugacagaggaaaugcccccgcucgaggaugagguggcggacggagccgcugccaccuauacccugacacgggccgcugauacggcccuuuggcugagaguugaggagccugacggccggcccuacgauauuuuuggggaccagccugcgccccucggaaccccugacuucacagcugugaucgucggcaccgccauccgccccagaacaaccucuggggccuaucugcaugaugcuuacguggacacgacaccgggagaugccgacuucaccccuuccaccggcaacacaaagauuguucugcggggcgggggaagcggccacguggggcagggacacuacuggcaauuuaagcccaucgcugucgaaggcgggggcucuagaccccaguaucaggaguacaaucucccugauuaugccggaccgaccgcgagcaaccaugaccuggccccucccguggcuccccgcaugccuggcgaacuucugcuccuguucgaguccgauaugcccgugugggacaauggggccggagcugccccugcgcagaaaauucacugccuucugcccaacgaguuuaucacacaucucuucgaucugcaagccccggcucuggccgaagcugcccuccugcgguacguucacccugacucuggcagaacgcuuuuugaguguaagcuguaucgcgaaggguacauggucguggccgcucccgugggacggcucaauuucccucuggauggcuauuuuagauucgacagcugggucuccgcguuuuacgugcugagccccguugggucuggccagggacgccgguga

SEQ ID NO: 28826 - RNA, 1719 nt, Artificial Sequence
  derived and/or modified sequence opt5 from VP1__Norovirus_and/or_Norovirus-like__JF781268
augaagauggccagcuccgacgcuacccccucuagcgauggcgccgggaaccuggugccugagucccagcaagaaguccucccgcuggcgcccguugcuggagccgcccuugcugccccuguggugggccagcagaauaucauugaccccuggaucaaagagaacuucguccaggcuccucaaggggaauuuacagugucucccaagaauagcccuggagagguucuggugaaccucgaacuguccccgagacuuaaucccuaccuggaucaccucucuaaaauguauaacgccuacgcgggcgggauggaggucgagauuauccuggccggaaaugcuuucacggccggcaaggugcugauugcugccguuccucccaacuuuccuaucgaaaauaucagcgcgucccaggccagccaguucccccaugugauugucgacgugcggacccucgagccgauccgccugccucuucccgaugugagaacaaacuuuuuccacuauaccacacaggaggaaccucggaugcgcauugucgcuuggcuguacacaccccucagaaccaauggcucuggggacgauuccuuuaccguuagcggacggauccugacgcgccccucuccugacuucgaguuuuccuuccuugugccgcccaccguggaaacaaaaaccgucagcuuuucugugccuggccugguuguggaggauauguccaacagcagauggcccgcccaaauuaaugggcucgucgugcggggaaacgaagcucagguugugcauuuccagaauggccgcugcacaaccgaggggacgcugcugggaacaaccacacucuccaucaacucuauuuguggccugagaggccuuagcgucucccaggccagcgugcgcggggccccugcucugaccgaagagaugcccccgcucgaggacgaagucgcggauggagccgcugccaccuauacacuggcccgggcugccgacacgacccuuuggcugagaguggaggaaccugauggccggcccuacgacaucuuuggggaccaaccugcgccccucggaacaccugauuucaccgcuguuaucgugggcacagccauucgccccagaaccgccucuggggcuuaucugcacgacgccuacgucgauacgacaccgggagacgcugauuucaccccuuccaccggcaacacaaagaucgugcugcggggcgggggaagcggccauguugggcagggacacuacuggcaguuuagacccauugccguggagggcgggggcucucgcccccaauaucaggaauacaaucucccugacuaugcgggaccgaccgccagcaaccacgaucuggcucccccugucgcuccccggaugccuggcgagcuucugcuccuguucgaguccgacaugcccgugugggauaauggggccggagccgcgccugcccagaagauccauugccuucugcccaacgaauuuauuacacaccucuucgaccugcaggcuccggcccuggcugaggccgcccuccugagauacgugcauccugauucuggccgcacgcuuuuugaauguaaacuguaucgggagggguacaugguugucgcugcgcccgccggaagacucaauuucccucuggacggcuauuuucgcuucgacagcuggguguccgcuuuuuacauccugagccccguggggucuggccaaggacggagauga

SEQ ID NO: 28827 - RNA, 1698 nt, Artificial Sequence
  derived and/or modified sequence opt5 from VP1__Norovirus_and/or_Norovirus-like__KT245136
augaagauggccagcaacggcgcugccgcgcccucccaggacggggcugccaaucuggugccugaaucucaacaggaaguccucgcccuggagccgguugcuggagccgcucuugccgcgcccguggccggccaguucaacgcuaucgauccuuggauuaaacagaauuuugugcaagcccccgcuggggaguucaccgucagcccuagaaacgcccccggagaagugcugauggaccucgaacugggcccugagaugaauccguuucuugcgcaccuggcccagauguacaacgcuuaugccgggggaauggagguucagaucauucucgcuggcaaugccuucacagccggcaagaucauugugugcgcugugcccccuaacuuucccccugaucggcuguccgcgucucaggccacgaauuucccccaugucaucauggacguucgcacccuggaaccggugguccucccucugcccgaugugagagcuggguuuuuccacuacaaccaacuucgggagccucgcaugagacugaugacacuccuguauacaccccuucgggccaauggaaccggcgacgaugccuuuaccgugagcugucgcguccugacaagacccaugcucgacuucgaauuuauguuccugguuccuccgaccguggagucccgggugacgcccuuuucugucccuaccuaccccgugguugagaugacaaacagccgcuggccugcuagaaucuccgggaugcaugugaaugccaaccagacccuggcgguccaguuccagaauggacggugcacacucgauggccaacugauggggaccacgcagcuuugugcugccgacgugugccgcaugagaggacgguauacaagcacccgcgccgaucccgcuggccugggcugggaccucgaugccacaacccugguugacgggccggaagcuagagugcaggcccggauuucugucuccgcgcaccuucaacuggaggaacucagcggacagccuuacgagguguauggcgaacagcccgccccucuggggacccccgacuuccaguguagacugaugggagagcucguccgccugccuucugcuaaccccguggcccaaucccgguuuagagaugcuuucuuugacacauacggcgcccuuuucgcgccggccguugggagcgugacggucaccgugaacaauucuuccagcuccgauuuugcuaacgaccagccuuucgaguuucugcccaucggaguugaaauuggcaauucugcccgcuacgaugaguucgcucuccccagcuauaacggcgccaucggggaaaaucggcaucuggccccuauugcugcgccgggauuucccggcgagaaccuuaucuucuuuuccagcaaucugccugugugggacucuacauccgcccagagcaacagacgcauuucuugccuccugcccaaugaguucauccagcacuuuuacgaucugcaagcuccuagccaguccgacgucgcccuccugcgguaugugcaccccgaaaccgauagauuccuuuucgaguguaaacuguaccgcgacgccuuucucacagugaacggggcuucuuaugccgaguucccuguuaauggauacagccgguuugauuccugggucaagcaguucuuuacccugagccccgugggcacggggucuggcagacgcuga

SEQ ID NO: 28828 - RNA, 1659 nt, Artificial Sequence
  derived and/or modified sequence opt5 from VP1__Norovirus_and/or_Norovirus-like__AJ844470
augaagauggccagcaaagacgcuucccccucuaccgauggcgccgcgaaccuggugccugagagccagcaagaaguccucgcucugcagccgguugccggggcccagaucgcugcccccguggcuggacaguucaaugugauugacccuuggaucuaccaaaacuuuguccaggcccccgagggcgaguucacaguguccccuagaaauucuacgggggaaauucuuaugaaccuggaacucggaccccagcugaauccuuaucuugcgcaccuggcccggauguacaacgcuuaugccggcggguuugagguucaggugcuccuggcuggaaaugccuucaccgcgggcaagaucauugucugcgccgugccgcccaacuuuccucugcaaaauaucagcgcugcccaggcuacacagcucccccauguuguggucgaugugcgccagcuggagccugugguccuuccccugccggacguuagagccggcuucuaccacuauaaccaaguggaagagucccggaugcgccucguggccauccuguacaccccucuuagaacaaauucugcuggggaugacgcguuuaccgucagcugucggauucugacacgccccgccccugauuucuccuuuuucuuucucaucccucccaccauugaaagcaaaacgacccccuucacacugccgagacugcccaucucugagaugaccaacucccgguuuccucucgugauuaagggaaugguuguggaccccaaucugccucuucaggcuaacuuccagaauggccgcaucacacuggauggggagcuccaaggaaccacgcugcccacaagcaccucuauuggcagaaucuccgggacauauaugagcucuaccccgucccggaucauucagcaugaagacagcggagauuccacccagccucgcgucuucaaccccguguggauggaccuuacagagaacaauuggacggaauuucagccuuucaacgaucaacccgccccucugggcugccccgacuuuaaagccaagauccucggcacccugauuagacagccgaauaacgggucuuacuacuucgacgcuuaucuggauacacggcagcacggaaccuuugccccuuacacaggccaugcggcuguucacagcgaccagcaagccgggcaccucgcccagggauauaagauccaguucucccccaccggcauugagagcgaucagaauacggaccugaaccaacuucccgauuacgggggagcuaugacagugucuaaaggccuggccccugcugccgcgccggacuuucccggcgaaaugauccucuauuucgucuccgauaugccugugcgcaaucccaacggggagagacgggacaccgagauccugugucuucugccucaggaaauggucacccauuuuuacgagcagcaggcccccagccaaggagauguggcucucguuagauauauuaaugccgaaacaggccgcgugauguucgaggggaagcugcaccggaacggauuuuucaccgucucugcuacagccagaacgcugaucgugccugacggcuacuuucgcuucgauagcuggguuaaucgguucuacacccucucccccauggggacaggcaacggaagacgccgggcgagauga

SEQ ID NO: 28829 - RNA, 1659 nt, Artificial Sequence
  derived and/or modified sequence opt5 from VP1__Norovirus_and/or_Norovirus-like__KJ196291
augaagauggccagcaaagacgcuucccccucuaccgauggcacagccaaccuggugccugagagccagcaagaaguccucgcgcugcagccgguugcuggggcccagaucgccgcucccguggccggacaguucaaugugauugacccuuggaucuaccaaaacuuuguccaggcucccgagggcgaguucacgguguccccuagaaauucuaccggggaaauucuuaugaaccuggaacucggaccccagcugaauccuuaucuugcccaccuggcgcggauguacaacgccuaugcuggcggguuugagguucaggugcuccuggccggaaaugcuuucacagccggcaagaucauugucugcgcggugccgcccaacuuuccucugcaaaauaucagcgccgcucaggccacccagcucccccauguuguggucgaugugcgccagcuggagccugugguccuuccccugccggacguuagagcuggcuucuaccacuauaaccaaguggaagagucccggaugcgccucguggccauccuguacacaccucuuagaaccaauucugccggggaugacgcuuuuacagucagcugucggauucugacccgccccgcgccugauuucuccuuuuucuuucucaucccucccacgauugaaagcaaaaccacacccuucacccugccgagacugcccaucucugagaugacaaacucccgguuuccucucgugauuaagggaaugguuguggaccccaaucugccucuucaggccaacuuccagaauggccgcaucacccuggauggggagcuccaaggaacgacacugcccaccagcacaucuauuggcagaaucuccgggacccauaugagcucuaccccgucccggaucauucagcacgaagacagcggagauuccacacagccucgcgucuucaaccccguguggauggaccuuacggagaacaauuggaccgaauuucagccuuucaacgaucaacccgcuccucugggcugccccgacuuuaaagccaagauccucggcacacugauuagacagccgaauaacgggucuuauuacuucgacgccuaccuggauacccggcagcauggaacauuugcuccuuauaccggccacgccgcgguucacagcgaccagcaagcugggcaucucgcccagggauacaagauccaguucucccccacgggcauugagagcgaucagaauacagaccugaaccaacuucccgauuaugggggagccaugaccgugucuaaaggccuggcuccugccgcugccccggacuuucccggcgaaaugauccucuacuucgucuccgauaugccugugcgcaaucccaacggggagagacgggacaccgagauccugugucuucugccucaggaaauggucacacacuuuuaugagcagcaggcgcccagccaaggagauguggcccucguuagauacauuaaugcugaaaccggccgcgugauguucgaggggaagcugcaucggaacggauuuuucacagucucugccacggcuagaacccugaucgugccugacggcuauuuucgcuucgauagcuggguuaaucgguucuacacacucucccccauggggaccggcaacggaagacgccgggccagauga

SEQ ID NO: 28830 - RNA, 1653 nt, Artificial Sequence
  derived and/or modified sequence opt5 from VP1__Norovirus_and/or_Norovirus-like__KU870455
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggauaacaucuccgcggcccagaucacgaugugcccucacgucauuguggacgugagacagcuggaacccguccugcucccgcugccugauauccggaaucgcuuuuuccauuauaaccaggaggacacccccagaaugcggcuuguugcuaugcuguacacaccucuccgcgccaauucuggggaagauguguuuaccgugagcuguagaguccugacacggcccgcucccgacuucgaguuuaccuuccuugugccuccgacaguugaguccaagaccaaacccuuuacgcugccuauucucacccugggagaacugagcaacucucgcuuccccgccgccaucgauaugcucuauacagacccuaacgaguccauugugguccaaccccagaauggcagaugcacccuggaugggacacuucagggaaccacgcagcuggugccgacacaaaucugugcuuuucggggcacccucauuagccagaacgcgcgcgccgcugaccugacagauucuccucagagagcccgggaccacccccuucauguucaagugaagaaucuggacgggacccaguacgauccuaccgacgauauccccgccguccucggagcuaucgacuucaaaggcacaguguucggcgucgccucccagcgcgaugugagcgggacgcaggaacaaggacacuaugcgaccagagcucacgaggcccauauugacacaaccgauccuaaguacgcccccaagcugggcacaauccugauuaaaucugaauccaccgacuuuacgacaaaccagccgauccgguucaccccuguugggaugggagauaauaacuggagacagugggagcuccccgacuacagcggcucccugacccuuaauaugaaccuggcucccgccgugucuccuagcuuuccgggggagcgcauucucuucuuucgguccaucguccccagcgcuggaggcuauggcucuggguacaucgauugccugauuccucaggaaugggugcaacacuucuaucaggaggccgcgcccucccagagcgccguugcucuugugagauacgucaauccugacacaggacgcaacaucuuugaagccaagcugcaucgggagggcuuccucaccguggcuaauucugggaacaaucccauugugguuccucccaacggauauuuuagauucgaagccugggucaaucaguuuuacacacuggcgccgaugggcagcgggcaaggccgccggagagcccaguga

SEQ ID NO: 28831 - RNA, 1653 nt, Artificial Sequence
  derived and/or modified sequence opt5 from VP1__Norovirus_and/or_Norovirus-like__AF414408
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccuagaaauucccccggggaaaugcugcuuaaccuggagcucggaccugagcugaauccguaccuuucucaccugagccgcauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugaagcagcuggagcccguccugcucccgcugccugacaucagaaaucgguuuuuccauuauaaccaggaagauacaccccgcaugagacuuguugcuaugcuguacaccccucuccgggccaauucuggggaggacguguuuaccgugagcugucgcguccugacaagacccgcucccgauuucgaguuuaccuuccuugugccuccgacaguugaauccaaaaccaagcccuuuacgcugccuauucucacccugggagagcugagcaacucucgguuccccgccgccaucgacaugcucuauacagauccuaacgaauccauugugguccaaccccagaauggccgcugcacccuggacgggacacuucagggaaccacgcagcuggugccgacacaaaucugugcuuuuagaggcacccucauuagccagacagcgcgggccgcugauucuaccggguccccucagcgcgccagaaaccacccccugcauguucaagugaaaaaucuugacggaacccaguacgauccuacagacgacauccccgccguccugggcgcuaucgauuucaagggcacgguguucggggucgccagccagcgggacgugucuggacagcaagagcagggccacuaugcgacccgcgcucacgaagcccauauugauacaaccgacccuaaguacgcccccaaacucgggacaauccugauuaaguccgauagcgacgauuuuaacaccaaucagccgaucagauucacgccuguuggaaugggcgacaacaauuggcggcagugggagcugcccgauuacuccgggcaccucacacugaacaugaaucuugcucccgccgugucuccuagcuuuccgggagagcggauucuguucuuucgcuccaucguccccagcgcuggcggcuaugggucuggauacaucgacugccucauuccucaagaaugggugcagcauuucuaucaggaggccgcgcccucccagagcgccguugcucuggugcgguacgucaacccugauaccggcagaaauaucuuugaagccaaacuucaccgcgagggguuccugaccguggcuaacucuggaaauaaccccauugugguuccucccaauggcuauuuucgguucgaagccugggucaaccaauuuuacacacucgcgccgauggggagcggccagggaagacgccgggcccaguga

SEQ ID NO: 28832 - RNA, 1653 nt, Artificial Sequence
  derived and/or modified sequence opt5 from VP1__Norovirus_and/or_Norovirus-like__AB084071
augaagauggccagcaacgacgcugcccccuccaaugauggcgcggcuaaccuggugccugaagccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaagaucauuuuugcugccguucccccucauuuccccguggauaacaucuccgcggcccagaucacgaugugcccucacgucauuguggacgugagacagcuggaacccguccugcucccgcugccugauauccggaaucgcuuuuuccauuauaaccaggagaauacccccagaaugcggcuuguugcuaugcuguacacaccucuccgcgccaacucuggggaagacguguuuaccgugagcuguagaguccugacacggcccgcucccgauuucgaguuuaccuuccuugugccuccgacaguugaguccaagaccaaacccuuuacgcugccuauucucacccugggagaacugagcaacucucgcuuccccgccgccaucgacaugcucuauacagauccuaaugaguccauugugguccaaccccagaacggcagaugcacccuggacgggacacuucagggaaccacgcagcuggugccgacacaaaucugugcuuuucggggcacccucauuagccagacagcgcgcgccgcugauucuaccgacuccccucagagagcccgggaucacccccugcauguucaagugaagaaucuugacgggacccaguacgacccuacagaugacauccccgccguccugggagcuaucgauuucaaaggcacgguguucggcgucgccagccagcgcgacgugucugggccucaggaacaaggacacuaugcgaccagagcucacgagacacauauugauaccacagaccccaaguacgccccgaagcucggcaccauccugauuaaauccgaaagcaacgauuuuaucacgaaucagccuauucgguucacacccguugggaugggagacaacaauuggagacagugggagcugcccgauuacuccggccgccucacccugaacaugaaucuugccccugcugugucuccgagcuuucccggggagcggauccuguucuuuagauccaucgucccuagcgccggaggcuauggcucuggguacauugacugccucaucccccaggaaugggugcaacacuucuaucaggaggcugccccuucccagagcgcgguugcccuggugcgcuacgucaaccccgauaccggacggaauauuuuugaagcuaaacuucauagagagggcuuccugacaguggccaacucugggaauaacccuaucgugguucccccgaauggauauuuucgcuucgaggcuugggucaaccaguuuuacacccucgccccuaugggcagcgggcaaggccggagacgcgcgcaguga

SEQ ID NO: 28833 - RNA, 1653 nt, Artificial Sequence
  derived and/or modified sequence opt5 from VP1__Norovirus_and/or_Norovirus-like__AF414407
augaagauggccagcaacgacgcugcccccuccaaugauggcgcggcuaaccuggugccugaggccaauaacgaagucauggcccucgagccgguugugggggcuucuaucgccgcucccgccgugggacagcaaaauauuaucgacccuuggauuagagaaaacuucguccaggcgccccagggcgaguuuaccgugagcccucgcaauucccccggggaaaugcugcuuaaccuggagcucggaccugagcugaauccguaccuuucucaccugagccggauguauaacggcuacgccgggggaaugcagguucaagugguccucgcuggcaaugccuucacagcuggcaagaucauuuuugccgcggugcccccucauuuccccguugaaaacaucuccgccgcucagaucacgaugugcccucacgugauugucgaugugagacagcuggagcccgugcugcucccgcugccugacauccggaaucgcuuuuuccauuauaaccaggaaaauacccccagaaugcggcuugucgccaugcuguacacaccucuccgcgcuaacucuggggaggauguuuuuaccgugagcuguagagugcugacacggcccgcccccgacuucgaguuuaccuuccuugucccuccgacaguggaauccaagaccaaacccuuuacgcugccuacccucacacugggagagcugagcaacccccgcuucccugccgcuauugauaugcucuauaccgaccccaaugaaucuaucguugugcaaccgcagaacggcagaugcacacuggaugggacccuucagggaacgacacagcuggucccuacccaaauuugugcguuucggggcacacucaucucccagaccgcccgcgcugccgacagcaccgauucuccccagagagcccggaaucacccucugcaugugcaaguuaagaaccuugacgggacacaguacgaucccacggacgacauuccugcugugcugggagccaucgauuucaaaggcaccgucuucggcguggcgucccagcgcgacgucagcgggcagcaagagcagggacacuaugcuacaagagcccacgaagcccauaucgauaccacagaccccaaguacgcuccgaagcucggcaccauucugaucaaaucugauuccgacgauuuuaauacgaaccagccuauucgguucacacccguggggaugggagacaauaacuggagacagugggagcugcccgauuacagcggccgccucacccugaauaugaaccuugccccugcuguuuccccgucuuuucccggggagcggauccuguucuuuagaagcauugugccuuccgccggaggcuauggcagcggguacaucgacugccucaucccccaagaauggguccagcacuucuaucaggaggcggccccuucucaguccgcuguggcccugguucgcuacgugaaucccgauaccggacggaacauuuuugaagcuaaacuucauagagagggcuuccugacagucgccaauagcgggaacaauccuaucguggugcccccgaacggauauuuucgcuucgaagcguggguuaaccaauuuuacacccucgccccuaugggcucugggcagggccggagacgcgcucaguga

SEQ ID NO: 28834 - RNA, 1653 nt, Artificial Sequence
  derived and/or modified sequence opt5 from VP1__Norovirus_and/or_Norovirus-like__AB039777
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccccauguauaacggcuacgccgggggaaugcaagugcaggucgugcucgccggcaaugcuuucacagccggcaaaaucauuuuugcugccguuccuccccauuucccuguggauaacaucuccgcggcccagaucacgaugugcccccacgucauuguggacgugcggcagcuggaaccggucccucugccccucccugauaucagaaaucgguuuuuccauuauaaccaggagaauaccccucgcaugagacugguugcuaugcuuuacacaccccugcgggccaacucuggggaagacguguuuaccgugagcugucgcguccucacaagacccgcuccggauuucgaguuuaccuuccuggugcccccuacaguugaguccaagaccaaacccuuuacgcuuccuauucugacccucggagaacugagcaacucucgguuccccgccgccaucgacaugcuguauacagauccgaaugaguccauugugguccaaccucagaacggccgcugcacccucgacgggacacugcagggaaccacgcagcuugugcccacacaaaucugugcuuuuagaggcacccugauuagccagacagcgcgggccgcugauucuaccgacuccccucagcgcgccagagaucacccccuccauguucaagugaagaaucuugggggaacccaguacgacccuacagacgauauccccgccguccugggcgcuaucgacuucaaaggcacgguguucggggucgccagccagcgggaugugucuggaccgcaggaacaaggccacuaugcgacccgcgcucacgaggcccauauugacacaaccgauccuaaguacgcccccaagcuggggacaauccucauuaaauccgaaagcaacgacuuuaccacgaaucagcccaucagauucacaccuguuggaaugggcgauaacaauuggcggcagugggagcugccggacuacuccgggagacugacccucaacaugaaucuggcucccgccgugucuccuagcuuucccggagagcgcauucuuuucuuucgguccaucgucccuagcgcuggcggcuaugggucuggauacaucgauugccugauuccccaggaaugggugcaacacuucuaucaggaggccgcgccuucccagagcgccguugcucucgugagauacgucaaccccgacaccggccgcaauaucuuugaagccaagcugcaucgggagggguuccuuacaguggcuaacucuggaaauaacccgauugugguuccucccaauggcuauuuuagauucgaagccugggucaaccaguuuuacacccuggcgccuauggggagcggccaaggacgccggagagcccaguga

SEQ ID NO: 28835 - RNA, 1653 nt, Artificial Sequence
  derived and/or modified sequence opt5 from VP1__Norovirus_and/or_Norovirus-like__AB078337
augaagauggccagcaacgacgcugcccccuccaaugauggcgcggcuaaccuggugccugaggccaaugacgaagucauggcccucgagccgguugugggggcuucuaucgccgcucccguggucggacagcaaaacauuaucgauccuuggauuagagaaaauuucgugcaggcgccccagggcgaguuuaccguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacagccggcaagaucauuuuugcugccguucccccucauuuccccguggaaaauaucuccgcggcccagaucacgaugugcccucacgucauuguggacgugagacagcuggagcccguccugcucccgcugccugauauccggaaccgcuuuuuccauuauaaucaggaaaacacccccagaaugcggcuuguugcuaugcuguacacaccucuccgcgccaauucuggggaggacguguuuaccgugagcuguagaguccugacacggcccgcucccgauuucgaguuuaccuuccuugugccuccgacaguugaauccaagaccaaacccuuuacgcugccuauucucacccugggagagcugagcaacucucgcuuccccgccgccaucgacaugcucuauacagauccuaacgaauccauugugguccaaccccagaauggcagaugcacccuggacgggacacuucagggaaccacgcagcuggugccgacacaaaucugugcuuuucggggcacccucauuagccagacagcgcgcgccgcugauucuaccgacuccccucagagagcccggaaccacccccugcauguucaagugaagaaucuugaugggacccaguacgacccuacagacgauauccccgccguccugggagcuaucgacuucaaaggcacgguguucggcgucgccagccagcgcgaugugucugggcagcaagagcagggacacuaugcgaccagagcucacgaagcccauauugacacaaccgauccuaaguacgcccccaagcucggcacaauccugauuaaauccgggagcgacgauuuuaacaccaaucagccgauccgguucacgccuguuggaaugggcgacaacaauuggagacagugggagcugcccgauuacuccgggcgccucacacugaacaugaaucuugcucccgccgugucuccuagcuuuccgggagagcggauucuguucuuuagauccaucguccccagcgcuggcggcuaugggucuggauacaucgacugccucauuccucaagaaugggugcagcacuucuaucaggaggccgcgcccucccagagcgccguugcucuggugcgcuacgucaacccugauaccggccggaauaucuuugaagccaaacuucauagagagggguuccugaccguggcuaacuguggaaauaaccccauugugguuccucccaauggcuauuuucgcuucgaagccugggggaaccaauuuuacacacucgcgccgaugggcucuggacagggccggagacgcgcccaguga

SEQ ID NO: 28836 - RNA, 1653 nt, Artificial Sequence
  derived and/or modified sequence opt5 from VP1__Norovirus_and/or_Norovirus-like__AB039776
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccccauguauaacggcuacgccgggggaaugcaagugcaggucgugcucgccggcaaugcuuucacagccggcaaaaucauuuuugcugccguuccuccccauuucccuguggauaacaucuccgcggcccagaucacgaugugcccccacgucauuguggacgugcggcagcuggaaccggucccucugccccucccugauaucagaaaucgguuuuuccauuauaaccaggagaauaccccucgcaugagacugguugcuaugcuuuacacaccccugcgggccaacucuggggaagacguguuuaccgugagcugucgcguccucacaagacccgcuccggauuucgaguuuaccuuccuggugcccccuacaguugaguccaagaccaaacccuuuacgcuuccuauucugacccucggagaacugagcaacucucgguuccccgccgccaucgacaugcuguauacagauccgaaugaguccauugugguccaaccucagaacggccgcugcacccucgacgggacacugcagggaaccacgcagcuugugcccacacaaaucugugcuuuuagaggcacccugauuagccagacagcgcgggccgcugauucuaccgacuccccucagcgcgccagagaucacccccuccauguucaagugaagaaucuggacgggacccaguacgacccuacagaugacauccccgccguccuuggagcuaucgauuucaaaggcacgguguucggcgucgccagccagcgggacgugucugggccgcaggaacaaggacacuaugcgacccgcgcucacgaggcccauauugauacaaccgacccuaaguacgcccccaagcugggcacaauccucauuaaauccgaaagcaacgauuuuaccacgaaucagcccaucagauucacaccuguugggaugggagacaacaauuggcggcagugggagcugccggauuacuccggcagacuggcucucaacaugaaucuggcccccgcugugucuccuagcuuucccggggagcgcauucuuuucuuucgguccaucgucccuagcgccggaggcuauggcucuggguacaucgacuaucugauuccccaggaaugggugcaacacuucuaccaggaggcggccccuucccagagcgcuguugcccucgugagauaugucaaccccgauaccggacgcaauaucuuugaagcuaagcugcaucgggagggcuuccuuaccguggccaacucugggaauaacccgauugugguuccucccaauggauacuuuagauucgaagcgugggucaaccaguuuuauacacuggccccuaugggcagcgggcaaggccgccggagagcucaguga

SEQ ID NO: 28837 - RNA, 1653 nt, Artificial Sequence
  derived and/or modified sequence opt5 from VP1__Norovirus_and/or_Norovirus-like__KT030674
augaagauggccagcuccgacgcugcccccucuaccgauggcgcggggaaccuggugccugagagccagcaagaaguccucccgcuggcucccguugccggagccgcucuugccgcuccuguggugggccagacaaauaucauugaccccuggaucaaggagaacuucguccaggccccucagggggaauuuacggugucccccaagaacucuccuggagagauucugguuaaucucgaacugggcccgaaacuuaaucccuaccuggaucaccucagcagaauguauaacuccuacgcugggggaaucgacgugauggucgugcuggccggcaaugcuuucaccgccggcaagguucugauugcugccaucccucccaacuuuccuguggagggggucucugcgagccaagccacacaguucccccaugugaucauugaugugcggacccucgacccgguccgccugccucuucccgauguuagauccacauuuuuccacuauaccaaugacacagagccuaaaaugcggcuggugaucuggcucuacacgccccugcgcaccaacggaagcggcgaugacucuuuuaccguguccgggcggauucuuacaagacccagccaggauuucgaauuugcuuuccugaucccuccgaccgucgagacaaagaccacgcccuuuucugugccuggauucuccguucaggaaaugagcaauucucgcuggcccgccgcuauuuccgccaugguggucagaggcaacgagccucaagugguucaguuucagaaugggcgggcccaucucgacggaaugcugcugggcacaacccccgugagcccgaacuauaucgcuuccuaccgcggcauuucuacagggaauagcagauccgcgagcucugaggccgaugaacgggcugucggauccuucgacguguggguccgccuccaggagccugacggccaacccuaugauaucuucgggaagcagccugcccccaucggaaccccugacuuuaaagccgugauuguuggcuucgcugccagaccccugaccagcgggucuuacgcgaacgaagcguacgugaacacaacggccagcgauuaugccccggcuaccggaaauaugcgguuuacaguccgcaacggcggcaccgggcacaucuccgccaauaaguacugggaguucaaaucuuuuggaguggaaggcgagagacauacagacauucaguaucaagaguacgaacuuccugauuauagcgggcagguugcuuccaaccacaaucuggccccucccguggcgccccggaugccgggagagagccuccugcuuuuccagucuaacaugcccgucugggacgauggcagaggggaauccaccccuaagaaaauccacugccugcucccccaggaguuuauuggccauuucuuugacaagcaagccccuagccugggagaugcugcccugcuccgcuacgugaaucaggaaacgaaccgggugcuguucgaguguaaacuuuauagagacggcuacaucacaguugcugccucuuccgggcugcucgauuuuccccuggacggauucuuucgcuucgacagcugggucuccucuuucuacauccuuagcccugugggcuccgggcagggacggagauga

SEQ ID NO: 28838 - RNA, 1653 nt, Artificial Sequence
  derived and/or modified sequence opt5 from VP1__Norovirus_and/or_Norovirus-like__DQ093067
augaagauggccagcaacgacgcugcccccuccaccgauggcgcggggaaucuggugccugagucucagcaagaaguccucccgcuggcucccguugccggagccgcucuugccgcuccuguggugggccagacaaacaucauugaccccuggaucaaggagaauuucguccaggccccucagggggaauuuacggugagccccaagaacuccccuggagagauucugguuaaucucgaacugggcccgaaacuuaaccccuaccuggaucaccucucuagaauguauaauagcuacgcugggggaaucgacgugauggucgugcuggccggcaacgcuuucaccgccggcaagguucugauugcugccaucccucccaauuuuccuguggagggggucuccgcgucucaagccacacaguucccccauguggugaucgauguccggacccucgacccgguucgccugccucuucccgaugugagaagcacauuuuuccacuauaccaacgacacagagccuaaaaugcggcuggugauuuggcucuacacgccccugcgcaccaauggauccggcgaugacagcuuuaccgucucugggagaauccuuacacggcccucccaggauuucgaauuugcuuuccugauuccuccgaccguggagacaaagaccacgcccuuuagcguuccuggauucucugugcaggaaauguccaacagccgcuggcccgccgcuaucucugccauggucgugagaggcaaugagccucaaguugugcaguuucagaacgggcgggcccaucucgacggaaugcugcugggcacaacccccgucuccccgaauuauauugcuagcuaccgcggcaucuccacagggaacucuagaagcgcguccagcgaggccgaugaacgggcugugggaucuuucgacgucugggugcgccuccaggagccugacggccaacccuaugauauuuucgggaagcagccugcccccaucggaaccccugacuuuaaagccguuaucgugggcuucgcugccagaccccugaccuccgggagcuacgcgaacgaagcguacgucaauacaacggccucugauuaugccccggcuaccggaaacaugcgguuuacagugcgcaauggcggcaccgggcacauuagcgccaacaaguacugggaguucaaauccuuuggaguugaaggcgaggggcauacaaauauccaguaucaagaguacgaacuuccugacuauucuggacagguggcuagcaaccacaaucuggccccucccgucgcgcccagaaugccgggcgagucccuccugcuuuuccagagcucuaugcccgugugggaugacgggcacggcgaauccaccccuaagaaaauucauugccugcucccccaggaguuuaucggacacuucuuugauaagcaagccccuagccugggcgacgcugcccugcuccgguacgugaaccaggaaacgaauagaguucuguucgaguguaaacuuuaucgcgauggguacauuacagucgcugccucuuccggacugcucgacuuuccccuggauggcuucuuucgguucgacagcuggguguccucuuucuacauccuuagcccugugggguccggacagggcagacgcuga

SEQ ID NO: 28839 - RNA, 1653 nt, Artificial Sequence
  derived and/or modified sequence opt5 from VP1__Norovirus_and/or_Norovirus-like__AF195847
augaagauggccagcuccgacgcugcccccucugcggauggcgcugggaaccuggugccugagagccagcaagaaguccucccgcuggcccccguugccggagcugcccuugcugccccuguggugggccagaccaauaucauugaccccuggaucaaggagaacuucguccaggcgccucagggggaauuuacagugucccccaagaacucuccuggagagauucugguuaaucucgaacugggcccgaaacuuaaucccuaccuggaucaccucagcagaauguauaacuccuacgccgggggaaucgacgugauggucgugcuggcuggcaaugccuucacggcuggcaagguucugauugccgcgaucccucccaacuuuccuguggagggggucucugccagccaagcuacccaguucccccaugugaucauugaugugcggacacucgacccgguccgccugccucuucccgauguuagauccaccuuuuuccacuauacaaaugacaccgagccuaaaaugcggcuggugaucuggcucuacacaccccugcgcaccaacggaagcggcgaugacucuuuuacgguguccgggcggauucuuaccagacccagccaggauuucgaauuugccuuccugaucccuccgacagucgagaccaagacaacccccuuuucugugccuggauucuccguucaggaaaugagcaauucucgcuggcccgcugccauuuccgccaugguggucagaggcaacgagccucaagugguucaguuucagaaugggcgggcucaucucgacggaaugcugcugggcacgacacccgugagcccgaacuauaucgcguccuaccgcggcauuucuaccgggaauagcagauccgccagcccugaggcugaugaacgggccgucggaucuuucgacguguggauccgccuccaggagcccgacggccaaccuuaugauaucuucgggaagcagcccgccccuauuggaacacccgacuuuaaagcugucaucgugggcuucgccgcgagaccgcugaccuccgggagcuacgcuaacgaagccuacguuaacaccacagccucugauuaugcuccugccacgggaaauaugcgguuuaccgugcgcaacggcggcagcgggcacauuuccgcuaauaaguacugggaguucaaaucuuuuggagucgaaggcgagagacauacagacauccaguaucaagaguacgaacuucccgauuauagcggacagguggccuccaaccacaaucuggcgcccccuguugccccgcggaugcccggggagagccuccugcuuuuccagucuaacaugccugugugggacgauggccacggggaauccacccccaagaaaauucauugccugcucccucaggaguuuaucggccacuucuuugacaagcaagcucccagccugggagaugccgcucugcucagauacgucaaucaggaaacaaaccgcgugcuguucgaguguaaacuuuaucgggacggcuacaucaccguggccgcgucuuccgggcugcucgauuuuccucuggacggauucuuuagauucgacagcuggguuuccucuuucuacauucuuagccccgucggcuccgggcagggacgccgguga

SEQ ID NO: 28840 - RNA, 1653 nt, Artificial Sequence
  derived and/or modified sequence opt5 from VP1__Norovirus_and/or_Norovirus-like__JQ970479
augaagauggccagcuccgacgcugcccccucugcggauggcgcugggaaccuggugccugagagccagcaagaaguccucccgcuggcccccguugccggagcugcccuugcugccccuguggugggccagaccaauaucauugaccccuggaucaaggagaacuucguccaggcgccucagggggaauuuacagugucccccaagaacucuccuggagagauucugguuaaucucgaacugggcccgaaacuuaaucccuaccuggaucaccucagcagaauguauaacuccuacgccgggggaaucgacgugauggucgugcuggcuggcaaugccuucacggcuggcaagguucugauugccgcgaucccucccaacuuuccuguggagggggucucugccagccaagcuacccaguucccccaugugaucauugaugugcggacacucgacccgguccgccugccucuucccgauguuagauccaccuuuuuccacuauacaaaugacaccgagccuaaaaugcggcuggugaucuggcucuacacaccccugcgcaccaacggaagcggcgaugacucuuuuacgguguccgggcggauucuuaccagacccagccaggauuucgaauuugccuuccugaucccuccgacagucgagaccaagacaacccccuuuucugugccuggauucuccguucaggaaaugagcaauucucgcuggcccgcugccauuuccgccaugguggucagaggcaacgagccucaagugguucaguuucagaaugggcgggcucaucucgacggaaugcugcugggcacgacacccgugagcccgaacuauaucgcguccuaccgcggcauuucuaccgggaauagcagauccgccagcucugaggcugaugaacgggccgucggauccuucgacguguggauccgccuccaggagccugacggccaacccuaugauaucuucgggaagcagccugcccccauuggaacaccugacuuuaaagcugucaucgugggcuucgccgcgagaccccugaccagcgggucuuacgcuaacgaagccuacguuaacaccacagccagcgauuaugcuccggccacgggaaauaugcgguuuaccgugcgcaacggcggcacagggcacauuuccgcuaauaaguacugggaguucagaucuuuuggagucgaaggcgagcggcauaccgacgugcaguaucaagaguacgaacuuccugauuauagcgggcagguugccuccaaccacaaucuggcgccucccguggcccccagaaugccgggagagagccuccugcuuuuccagucuaacaugcccgucugggacgauggccgcggggaauccacaccuaaaaagauccacugccugcucccccaggaguuuauuggccauuucuuugacaaacaagcuccuagccugggagaugccgcucugcuccgguacgugaaucaggaaaccaacagagugcuguucgaguguaaacuuuaucgcgacggcuacaucacgguugccgcggccucugggcugcucgauuuuccccuggacggauucuuucgguucgacuccugggucagcuccuucuacauccuuucuccugugggcagcgggcagggaagacgcuga

SEQ ID NO: 28841 - RNA, 1653 nt, Artificial Sequence
  derived and/or modified sequence opt5 from VP1__Norovirus_and/or_Norovirus-like__FM865412
augaagauggccagcuccgacgcugcccccucuaccgauggcgcggggaaccuggugccugagagccagcaagaaguccucccgcuggcucccguugccggagccgcucuugccgcuccuguggugggccagacaaauaucauugaccccuggaucaaggagaacuucguccaggccccucagggggaauuuacggugucccccaagaacucuccuggagagauucugguuaaucucgaacugggcccgaaacuuaaucccuaccuggaucaccucagcagaauguauaacuccuacgcugggggaaucgacgugauggucgugcuggccggcaaugcuuucaccgccggcaagguucugauugcugccaucccucccaacuuuccuguggagggggucucugcgagccaagccacacaguucccccaugugaucauugaugugcggacccucgacccgguccgccugccucuucccgauguuagauccacauuuuuccacuauaccaaugacacagagccuaaaaugcggcuggugaucuggcucuacacgccccugcgcaccaacggaagcggcgaugacucuuuuaccguguccgggcggauucuuacaagacccagccaggauuucgaauuugcuuuccugaucccuccgaccgucgagacaaagaccacgcccuuuucugugccuggauucuccguucaggaaaugagcaauucucgcuggcccgccgcuauuuccgccaugguggucagaggcaacgagccucaagugguucaguuucagaaugggcgggcccaucucgacggaaugcugcugggcacaacccccgugagcccgaacuauaucgcuuccuaccgcggcauuucuacagggaauagcagauccgcgagcucugaggccgaugaacgggcugucggauccuucgacguguggguccgccuccaggagccugacggccaacccuaugauaucuucgggaagcagccugcccccaucggaaccccugacuuuaaagccgugauuguuggcuucgcugccagaccccugaccagcgggucuuacgcgaacgaagcguacgugaacacaacggccagcgauuaugccccggcuaccggaaauaugcgguuuacaguccgcaacggcggcaccgggcacaucuccgccaauaaguacugggaguucaaaucuuuuggaguggaaggcgagagacauacaaacauucaguaucaagaguacgaacuuccugacuauagcgggcagguugcuuccaaucacaaccuggccccucccguggcgccccggaugccgggagagagccuccugcuuuuccagucuaauaugcccgucugggaugacggccacggggaauccaccccuaagaaaauccauugccugcucccccaggaguuuauuggccacuucuuugauaagcaagccccuagccugggagacgcugcccugcucagauacgugaaccaggaaacgaaucgcgugcuguucgaguguaaacuuuaucgggauggcuacaucacaguugcugccucuuccgggcugcucgacuuuccccuggauggauucuuuagauucgacagcugggucuccucuuucuacauccuuagcccugugggcuccgggcagggacgccgguga

SEQ ID NO: 28842 - RNA, 1653 nt, Artificial Sequence
  derived and/or modified sequence opt5 from VP1__Norovirus_and/or_Norovirus-like__AF414426
augaagauggccagcuccgacgcugcccccucuaccgauggcgcggggaaccuggugccugagagccagcaagaaguccucccgcuggcucccguugccggagccgcucuugccgcuccuguggugggccagacaaauaucauugaccccuggaucaaagagaacuucguccaggccccucagggggaauuuacggugucccccaagaacucuccuggagagauucugguuaaucucgaacugggcccgaaacuuaaucccuaccuggaucaccucagcagaauguauaacuccuacgcugggggaaucgacgugauggucgugcuggccggcaaugcuuucaccgccggcaagguucugauugcugccaucccucccaacuuuccuguggagggggucucugcgagccaagccacacaguucccccaugugaucauugaugugcggacccucgacccgguccgccugccucuucccgauguuagauccacauuuuuccacuauaccaaugacacagagccuaaaaugcggcuggugaucuggcucuacacgccccugcgcaccaacggaagcggcgaugacucuuuuaccguguccgggcggauucuuacaagacccagccaggauuucgaauuugcuuuccugaucccuccgaccgucgagacaaagaccacgcccuuuucugugccuggauucuccguucaggaaaugagcaauucucgcuggcccgccgcuauuuccgccaugguggucagaggcaacgagccucaagugguucaguuucagaaugggcgggcccaucucgacggaaugcugcugggcacaacccccgugagcccgaacuauaucgcuuccuaccgcggcauuucuacagggaauagcagauccgcgagcucugaggccgaugaacgggcugucggauccuucgacguguggguccgccuccaggagccugacggccaacccuaugauaucuucgggaagcagccugcccccaucggaaccccugacuuuaaagccgugauuguuggcuucgcugccagaccccugaccagcgggucuuacgcgaacgaagcguacgugaacacaacggccagcgauuaugccccggcuaccggaaauaugcgguuuacaguccgcaacggcggcaccgggcacaucuccgccaauaaguacugggaguucaaaucuuuuggaguggaaggcaagagacauacaagcauucaguaucaagaguacgagcuuccugacuauuccgggcagguugcuagcaaccacaaucuggccccucccguggcgccccggaugccgggagaaucucuccugcuuuuccaguccaacaugcccgucugggaugacggccacggggagagcaccccuaaaaagauccauugccugcucccccaggaauuuauuggccacuucuuugauaagcaagccccuucucugggagacgcugcccugcucagauacgugaaucaggagacgaaccgcgugcuguucgaauguaaacuuuaucgggauggcuacaucacaguugcugccuccagcgggcugcucgacuuuccccuggauggauucuuuagauucgacuccugggucucuagcuucuacauccuuuccccugugggcucugggcagggacgccgguga

SEQ ID NO: 28843 - RNA, 1653 nt, Artificial Sequence
  derived and/or modified sequence opt5 from VP1__Norovirus_and/or_Norovirus-like__AF414427
augaagauggccagcuccgacgcugcccccucugcggauggcgcugggaaccuggugccugagagccagcaagaaguccucccgcuggcccccguugccggagcugcccuugcugccccuguggugggccagaccaauaucauugaccccuggaucaaggagaacuucguccaggcgccucagggggaauuuacagugucccccaagaacucuccuggagagauucugguuaaucucgaacugggcccgaaacuuaaucccuaccuggaucaccucagcagaauguauaacuccuacgccgggggaaucgacgugauggucgugcuggcuggcaaugccuucacggcuggcaagguucugauugccgcgaucccucccaacuuuccuguggagggggucucugccagccaagcuacccaguucccccaugugaucauugaugugcggacacucgacccgguccgccugccucuucccgauguuagauccaccuuuuuccacuauacaaaugacaccgagccuaaaaugcggcuggugaucuggcucuacacaccccugcgcaccaacggaagcggcgaugacucuuuuacgguguccgggcggauucuuaccagacccagccaggauuucgaauuugccuuccugaucccuccgacagucgagaccaagacaacccccuuuucugugccuggauucuccguucaggaaaugagcaauucucgcuggcccgcugccauuuccgccaugguggucagaggcaacgagccucaagugguucaguuucagaaugggcgggcucaucucgacggaaugcugcugggcacgacacccgugagcccgaacuauaucgcguccuaccgcggcauuucuaccgggaauagcagauccgccagcacagaggcugaugaacgggccgucggaucuuucgacguguggauccgccuccaggagccugacggccaacccuaugauaucuucgggaagcagccugcccccauuggaaccccugacuuuaaagcugucaucgugggcuucgccgcgagaccccugaccuccgggagcuacgcuaacgaagccuacguuaacacaacggccucugauuaugcuccggccaccggaaauaugcgguuuacagugcgcaacggcggcagcgggcacauuuccgcuaauaaguacugggaguucaaaucuuuuggagucgaaggcgagagacauaccgacauccaguaucaagaguacgaacuuccugauuauagcggacagguggccuccaaccacaaucuggcgccucccguugcuccccggaugccgggggagagccuccugcuuuuccagucuaacaugcccgugugggacgauggccacggggaauccacaccuaagaaaauucauugccugcucccccaggaguuuaucggccacuucuuugacaagcaagccccuagccugggagaugccgcucugcucagauacgucaaucaggaaaccaaccgcgugcuguucgaguguaaacuuuaucgggacggcuacaucacgguggccgcgucuuccgggcugcucgauuuuccccuggacggauucuuuagauucgacagcuggguuuccucuuucuacauucuuagcccugucggcuccgggcagggacgccgguga

SEQ ID NO: 28844 - RNA, 1653 nt, Artificial Sequence
  derived and/or modified sequence opt5 from VP1__Norovirus_and/or_Norovirus-like__JQ613567
augaagauggccagcuccgacgcugcccccucuaccgauggcgcggggaaccuggugccugagagccagcaagaaguccucccgcuggcucccguugccggagccgcucuugccgcuccuguggugggccagacaaauaucauugaccccuggaucaaggagaacuucguccaggccccucagggggaauuuacggugucccccaagaacucuccuggagagauucugguuaaucucgaacugggcccgaaacuuaaucccuaccuggaucaccucagcagaauguauaacuccuacgcugggggaaucgacgugauggucgugcuggccggcaaugcuuucaccgccggcaagguucugauugcugccaucccucccaacuuuccuguggagggggucucugcgagccaagccacacaguucccccaugugaucauugaugugcggacccucgacccgguccgccugccucuucccgauguuagauccacauuuuuccacuauaccaaugacacagagccuaaaaugcggcuggugaucuggcucuacacgccccugcgcaccaacggaagcggcgaugacucuuuuaccguguccgggcggauucuuacaagacccagccaggauuucgaauuugcuuuccugaucccuccgaccgucgagacaaagaccacgcccuuuucugugccuggauucuccguucaggaaaugagcaauucucgcuggcccgccgcuauuuccgccaugguggucagaggcaacgagccucaagugguucaguuucagaaugggcgggcccaucucgacggaaugcugcugggcacaacccccgugagcccgaacuauaucgcuuccuaccgcggcauuucuacagggaauagcagauccgcgagcucugaggccgaugaacgggcugucggauccuucgacguguggguccgccuccaggagccugacggccaacccuaugauaucuucgggaagcagccugcccccaucggaaccccugacuuuaaagccgugauuguuggcuucgcugccagaccccugaccagcgggucuuacgcgaacgaagcguacgugaacacaacggccagcgauuaugccccggcuaccggaaauaugcgguuuacaguccgcaacggcggcaccgggcacaucuccgccaauaaguacugggaguucaaaucuuuuggaguggaaggcgagagacauacagacauucaguaucaagaguacgaacuuccugauuauagcgggcagguugcuuccaaccacaaucuggccccucccguggcgccccggaugccgggagagagccuccugcuuuuccagucuaacaugcccgucugggacgauggccacggggaauccaccccuaagaaaauccauugccugcucccccaggaguuuauuggccacuucuuugacagacaagccccuagccugggagaugcugcccugcuccgcuacgugaaucaggaaacgaaccgggugcuguucgaguguaaacuuuauagagacggcuacaucacaguugcugccucuuccgggcugcucgauuuuccccuggacggauucuuucgcuucgacagcugggucuccucuuucuacauccuuagcccugugggcuccgggcagggacggagauga

SEQ ID NO: 28845 - RNA, 1653 nt, Artificial Sequence
  derived and/or modified sequence opt5 from VP1__Norovirus_and/or_Norovirus-like__KC894731
augaagauggccagcuccgacgcugcccccucuaccgauggcgcggggaaccuggugccugagagccagcaagaaguccucccgcuggcucccguugccggagccgcucuugccgcuccuguggugggccagacaaauaucauugaccccuggaucaaggagaacuucguccaggccccucagggggaauuuacggugucccccaagaacucuccuggagagauucugguuaaucucgaacugggcccgaaacuuaaucccuaccuggaucaccucagcagaauguauaacuccuacgccgggggaaucgacgugauggucgugcuggccggcaaugcuuucaccgccggcaagguucugauugcugccaucccucccaacuuuccuguggaggucgugucugcgagccaagccacacaguucccccaugugaucauugauguccggacccucgacccgguucgccugccucuucccgaugugagauccacauuuuuccacuauaccaaugacacagagccuaaaaugcggcuggugaucuggcucuacacgccccugcgcaccaacgggagcggagaugacucuuuuaccgucuccggccggauucuuacaagacccagccaggauuucgaauuugcuuuccugaucccuccgaccguggagacaaagaccacgcccuuuucuguuccuggguucuccgugcaggaaaugagcaauucucgcuggcccgccgcuauuuccgccauggucgugagaggaaacgagccucaaguugugcaguuucagaauggccgggcccaucucgacgggaugcugcugggaacaacccccgucagcccgaacuauaucgcuuccuaccgcggcauuucuacaggcaauagcagauccgcgagcccugaggccgaugaacgggcuguggggucuuucgacgucugggugcgccuccaggagcccgacggacaaccuuaugauaucuucggcaagcagcccgccccuaucgggacccccgacuuuaaagccguuauugugggauucgcugccagaccgcugaccuccggcagcuacgcgaacgaagccuacgucaacacaacggcuucuaauuaugccccugcuaccgggaacaugcgguuuacagugcgcaauggaggcaccggccacacaagcgccaacaaguacugggaguucaaauccuuugggguugaaggagagagacauaccggcauccaguaucaagaguacgaacuucccgauuauucuggacagguggcuagcaaucacaaccuggcgcccccugucgcgccgcggaugcccggggagucccuccugcuuuuccagagcaauaugccugugugggacgauggccacggggaaucuacgcccaagaaaauucauugccugcucccucaggaguuuaucggccacuucuuugacaagcaagcccccucccugggagaugcugcccugcucagauacgugaaccaggaaacaaaucgcguucuguucgaguguaaacuuuaucgggacggcuacauuaccgucgcugccagcucugggcugcucgauuuuccucuggacggauucuuuagauucgauuccugggugagcuccuucuacauccuuucucccgugggcagcgggcagggacgccgguga

SEQ ID NO: 28846 - RNA, 1647 nt, Artificial Sequence
  derived and/or modified sequence opt5 from VP1__Norovirus_and/or_Norovirus-like__AF427118
augaagauggccagcaacgacgcugcccccuccucugauggcgcggcugggcuggugccugagagcaauaacgaagucauggcccucgagccgguugccggagcuucccuggccgcucccgugaccggccagacaaauaucauugacccuuggaucagaaugaacuucgugcaagcccccaauggggaauuuacggucucuccucggaacagccccggagaggugcuucugaaucucgaacugggcccugagcuuaacccguaccuggcgcaccucucccgcauguauaauggguacgccggaggcauggagguucagauuaugcuggcuggcaacgccuucaccgcugggaaacugaucuuugccgcggugcccccucauuuccccauugaaaaucucucuccuccccagaucacaauguuuccgcacgucaucauugaugugagaacccuggagccuguucuucugcccaugccugacauccggaacagcuucuuucauuucauucagcgcgaugaacccaagaugagacucguggccaugcuguauacaccccuucgguccaauggaagcggcgacgaugucuuuaccgugucuugccgcgugcugacaagaccuaccccggacuucgauuuuacguaccucguucccccuaccgucgaguccaaaagcaagcccuucacacugccuauccugacccucggggagcugacaaacucucgguuuccccuuccgauugacgugcuguauaccaauccuaacgaauccgcuaucgugcaaugucagaacggacgcugcacgcucgauggcgagcugcaggggacaacccagcuucugcccacaggaauuugugccuucagaggcaaagucacccaacaggugcaggacgaacaccggggcacccauuggaauaugacaguuacgaaccucaaugggaccccuuucgaucccacagaggacgugccugcuccccugggaaccccggacuuuagcggccagaucuacggggucaucucucaacgcaacacaaauaccgugccuggagaaggcgaucugcccgccaacagagcccacgaggcuguuauugcgacguauucccccaaguucacaccuaagcucgggaauauccaguuuagcaccugggagacccaggacguguccucuggacaaccgacaaaauucacccccgucggccuggccagcguggaugcuaacucccacuuugaccaguggacacuuccuagcuacucuggcgcccugacgcucaauaugaaccuggcccccuccgucgcuccuguguuccccggggaaugccuucuguuuuuccggagcuuuauuccucucaagggaggcuacgggaaucccgccaucgauugucugaugccgcaggaguggguucagcaucuguaucaagaaucugcgccuagccucuccgacguggcucugguccgcuacgugaaccccgagaccggaagaacacuuuucgaagccaaacugcaccggaauggcuuucucaccguugccagaaacucugcugggccuguggucgcccccacaaauggcuauuuccgcuuugauagcugggugaaccaguucuacacccuggcuccgaugggaaacggcuccgggcggagacgcaugcaguga

SEQ ID NO: 28847 - RNA, 1647 nt, Artificial Sequence
  derived and/or modified sequence opt5 from VP1__Norovirus_and/or_Norovirus-like__AY237415
augaagauggccagcaacgacgcugcccccuccucugauggcgcggcugggcuggugccugagagcaauaacgaagucauggcccucgagccgguugccggagcuucccuggccgcucccgugaccggccagacaaauaucauugacccuuggaucagaaugaacuucgugcaagcccccaauggggaauuuacggucucuccucggaacagccccggagaggugcuucugaaucucgaacugggcccugagcuuaacccguaccuggcgcaccucucccgcauguauaauggguacgccggaggcauggagguucagauuaugcuggcuggcaacgccuucaccgcugggaaacugaucuuugccgcggugcccccucauuuccccauugaaaaucucucuccuccccagaucacaauguuuccgcacgucaucauugaugugagaacccuggagccuguucuucugcccaugccugacauccggaacagcuucuuucauuucauucagcgcgaugaacccaagaugagacucguggccaugcuguauacaccccuucgguccaauggaagcggcgacgaugucuuuaccgugucuugccgcgugcugacaagaccuaccccggacuucgauuuuacguaccucguucccccuaccgucgaguccaaaagcaagcccuucacacugccuauccugacccucggggagcugacaaacucucgguuuccccuuccgauugacgugcuguauaccaauccuaacgaauccgcuaucgugcaaugucagaacggacgcugcacgcucgauggcgagcugcaggggacaacccagcuucugcccacaggaauuugugccuucagaggcaaagucacccaacaggugcaggacgaacaccggggcacccauuggaauaugacaguuacgaaccucaaugggaccccuuucgaucccacagaggacgugccugcuccccugggaaccccggacuuuagcggccagaucuacggggucaucucucaacgcaacacaaauaccgugccuggagaaggcaaccugcccgccaauagagcccacgaggcuguuauugcgacguauucccccaaguucacaccuaagcucgggaacauccaguuuagcaccugggagacccaggauguguccucuggacaaccgacaaaauucacccccgucggccuggccagcguggacgcuaauucccacuuugaucaguggacacuuccuagcuacucuggcgcccugacgcucaacaugaaucuggcccccuccgucgcuccuguguuccccggggaaugccuucuguuuuuccggagcuuuauuccucucaagggaggcuacgggaaccccgccaucgacugucugaugccgcaggaguggguucagcaucuguaucaagaaucugcgccuagccucuccgauguggcucugguccgcuacgugaaucccgagaccggaagaacacuuuucgaagccaaacugcaccggaacggcuuucucaccguugccagaaauucugcugggccuguggucgcccccacaaacggcuauuuccgcuuugacagcugggugaaccaguucuacacccuggcuccgaugggaaauggcuccgggcggagacgcaugcaguga

SEQ ID NO: 28848 - RNA, 1647 nt, Artificial Sequence
  derived and/or modified sequence opt5 from VP1__Norovirus_and/or_Norovirus-like__AF504671
augaagauggccagcaacgacgcugcccccuccaaugauggcgcggcugggcuggugccugagucuaacaaugaagucauggcccucgagccgguugccggagcuagccuggccgcucccgugaccggccagacaaacaucauugacccuuggaucagaaugaauuucgugcaagcccccaacggggaauuuacggucuccccucgcaauucucccggagaggugcuucugaaccucgaacugggcccugagcuuaauccguaccuggcgcaccucagccggauguauaacggguacgccggaggcauggagguucagauuaugcuggcuggcaaugccuucaccgcugggaaacugaucuuugccgcggugcccccucauuuccccauugaaaaccucuccccuccccagaucacaauguuuccgcacgucaucauugaugugagaacccuggagccuguucuucugcccaugccugacauccgcaauucuuucuuucauuucauucagcgggaugaacccaagaugagacucguggccaugcuguauacaccccuucggagcaacggauccggcgacgaugucuuuaccgugagcugccgcgugcugacaagaccuaccccggacuucgauuuuacguaccucguucccccuaccgucgagucuaaauccaagcccuucacacugccuauccugacccucggggagcugacaaauagccgguuuccccuuccgauugacgugcuguauaccaacccuaacgaaucugcuaucgugcaaugucagaauggacgcugcacgcucgauggcgagcugcaggggacaacccagcuucugcccacaggaauuugugccuucagaggcaaagucacccaacaggugcaggacgaacaccggggcacccauuggaacaugacaguuacgaaucucaacgggaccccuuucgaucccacagaggacgugccugcuccccugggaaccccggacuuuuccggccagaucuacggggucaucagccaacgcaauacaaacaccgugccuggagaaggcaaucugcccgccaacagagcccacgaggcuguuauugcgacguauucucccaaguucacaccuaagcucgggaauauccaguuuuccaccugggagacccaggaugugagcuccggacaaccgacaaaauucacccccgucggccuggccucuguggacgcuaacagccacuuugaucaguggacacuuccuuccuacagcggcgcccugacgcucaauaugaaccuggcccccucugucgcuccuguguuccccggggaaugccuucuguuuuuccgguccuuuauuccucucaagggaggcuacgggaaucccgccaucgacugucugaugccgcaggaguggguucagcaucuguaucaagaaagcgcgccuucucucagcgauguggcucugguccgcuacgugaaccccgagaccggaagaacacuuuucgaagccaaacugcaccggaauggcuuucucaccguugccagaaacuccgcugggccuguggucgcccccacaaacggcuauuuccgcuuugacucuugggugaaucaguucuacacccuggcuccgaugggaaacggcagcgggcggagacgcaugcaguga

SEQ ID NO: 28849 - RNA, 1647 nt, Artificial Sequence
  derived and/or modified sequence opt5 from VP1__Norovirus_and/or_Norovirus-like__KJ194504
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccauugauaaucuguccgcugcccagaucaccaugugcccucaugucauuguggacguucgccaacuggaacccaucaaccucccgaugccugaugugagaaauaacuucuuucacuauaaccagggcucugacagccggcugcgccuugucgccaugcuguacacaccccucagagcuaauaacuccggggaugacguguucaccgugucuugucggguccugacacgcccuagccccgauuuuuccuucaauuuucuuguucccccuaccguggagagcaagacaaaaccguucacccugcccauucucacgaucucugaaauguccaacagcagauuuccugugcccauugacucucugcauaccuccccuacagagaauaucgucgugcagugccagaacggacggguuacccuggauggcgagcucauggggacaacccaacugcuucccagccagaucugugcguuccgcggaacgcugacaagaucuaccucccgggccagcgaccaggcugauacaccgaccccucgccaguucgaccacagauggcauauucaacucgacaaucugaacggcacccccuaugauccugccgaagacauccccgccccucuuggcacacccgauuuucgggggaagguguucggagucgcuucccagcgcaauccggacggcacgaccagagcccacgaggcgaaaguggauacaaccacaaaccgguuuaccccuaagcuggggucucucgaaauuaucacggagagcgaagacuucgauacaaaucaguccaccaaguuuacccccguuggagugggcgucgacaacgaggaggaguuccaacaguggagccugcccaauuacucugggcaguuuacacacaacaugaaucuggcuccugccguggccccgaacuuccccggagaacagcuccuguuuuucagaucccaacuuccuagcucuggcggcuggagcaacgggauucuggauugccucgucccccaggaaugggugcagcauuuuuaucaggaguccgcuccugcccaaacccagguugcucuggugcgcuacgucaaucccgacacaggacgggugcuuuucgaagccaaacugcacaagcucggcuuuaugacgaucgcgaaaaacggggauucuccuaucaccguucccccgaauggauacuucagauucgagagcugggugaacccuuuuuauacacuggcccccaugggcaccgggaauggccgccggagaauccaguga

SEQ ID NO: 28850 - RNA, 1647 nt, Artificial Sequence
  derived and/or modified sequence opt5 from VP1__Norovirus_and/or_Norovirus-like__KJ194500
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugucccucgaacuggggccugagauuaacccguaccuugcucaccuggcccggauguauaauggauacgcuggcggcuucgagguccaggugguucucgccgggaacgcguuuacggccggaaaaaucaucuucgcugccauucccccuaauuuucccaucgauaaccugucugcugcccagauuaccaugugcccucaugugaucgucgacgugcgccaacuggaacccguuaaucucccgaugccugaugugagaaacaauuucuuucacuauaaccagagcuccgagucucggcugcgccuuauugccaugcuguacacaccccucagagcuaacaauagcggcgacgaugucuucaccguguccugucgggugcugacacgcccuagccccgacuuuucuuucaacuuucuuguucccccuaccgucgaauccaagacaaaaccguucacccugcccauccucacgauuagcgagaugucuaauuccagauuuccugugcccaucgauagccugcauaccucuccuacagagaacaucgugguccagugccagaaugggcgggugacccuggacggagaacucaugggcacaacccaacugcuucccucccagauuugugcguuccgcgggacgcugacaggaagcaccuccagagccucugaucagacagacaccccgaccccucggcaguucgaucgcagauggcacauccaacucgacaaccugaauggcacacccuaugacccugcugaggauauucccgccccucuuggcacgcccgacuuucgggggaagguuuucggaguggccagccagcgcaacccggauagagcuacccgggcccaugaagcgaaagucgacacaaccuccgauagauuugcuccuaagcugggcagccucgagaucacaaccgaaucuggggacuucgaggccaaucagcccacgaaguuuacacccgugggaauuggcguugauaacgaggccgaguuccaacaguggucccugccuaauuacagcgggcagaucacccacaacaugaaucuggcuccggccguggcucccaacuuuccuggagaacagcuccuguucuuucgcucucaacuucccagcuccggcggcuggucuaaugggguccuggacugccuccugccucaggaaugggugcagcacuucuaucaggagagcgcccccgcgcaaacccaggucgcccuugugcgguacguuaacccugauacaggaagagugcuguuugaagcuaaacuccauaagcugggcuucaugaccaucgccaaaaacggggacucccccauuacagucccgccuaauggauacuuucgcuucgagagcugggugaaccccuucuauacgcuggcuccuaugggcaccgggaauggccggagacgcauccaguga

SEQ ID NO: 28851 - RNA, 1647 nt, Artificial Sequence
  derived and/or modified sequence opt5 from VP1__Norovirus_and/or_Norovirus-like__DQ093063
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaagugaucuucgcugccauucccccuaacuuucccaucgacaaucuguccgcugcccagaucaccaugugcccucaugucauuguggauguucgccaacuggagcccaucaaccucccgaugccugacgugagaaauaacuucuuucacuauaaccagggcucugauagccggcugcgccuuauugccaugcuguacacaccccucagagcuaauaacuccggggacgaugucuucaccgugucuugucgggugcugacacgcccuagccccgacuuuuccuucaauuuucuuguucccccuaccgucgaaagcaagacaaaaccguucacccugcccauccucacgauuucugagauguccaacagcagauuuccugugcccaucgauucucugcauaccuccccuacagaaagcguggucgugcagugccagaauggacggguuacccuggacggcgagcucauggggacaacccaacugcuucccucucagaucugugcguuccgcggaacgcugacaagaccgaccaaccgggccuccgaucaggcugacacagccaccccucgccucuucaaucaccaguggcauauucaacuggacaaccuuaauggcacccccuaugauccugccgaggacauccccgcuccucugggcacacccgauuuuagagggaagguguucggagucgccagccagcgggacccggauggcacgacccgcgcgcacgaagcuaaaguggacacaaccuccgggagauuuacaccuaagcucggaucucuggagauuaccacggaaagcgaugacuucaaccagaauaagcccacacgguuuacccccguuggcaucgggguggauaacgaggccgacuuccaacaguggauucugccugauuacuccggacaguuuacccacaauaugaaccucgccccggcugucgcccccaauuucccuggcgaacagcugcuguuuuucagaagccaacuucccucuuccggcgggcgcagcaacggaauccucgacugccuggugccucaggaguggguccagcauuuuuaucaggagucugcucccgcccaaacacagguggcgcuuguucgguacgugaacccugacaccggcagaguccuguucgaagccaaacuccacaagaugggguuuaugacaaucgcuaaaaauggagauagccccauuacggugccgccuaacggcuacuuccgcuucgaguccuggguuaaucccuuuuauacccuggccccuauggggacaggcaagggacggagacgcauccaguga

SEQ ID NO: 28852 - RNA, 1647 nt, Artificial Sequence
  derived and/or modified sequence opt5 from VP1__Norovirus_and/or_Norovirus-like__AY030313
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaagugaucuucgcugccauucccccuaacuuucccaucgacaaucuguccgcugcccagaucaccaugugcccucaugucauuguggauguucgccaacuggagcccaucaaccucccgaugccugacgugagaaauaacuucuuucacuauaaccagggcucugauagccggcugcgccuuauugccaugcuguacacaccccucagagcuaauaacuccggggacgaugucuucaccgugucuugucgggugcugacacgcccuagccccgacuuuuccuucaauuuucuuguucccccuaccgucgaaagcaagacaaaaccguucacccugcccauccucacgauuucugagauguccaacagcagauuuccugugcccaucgauucucugcauaccuccccuacagaaagcaucgugguccagugccagaauggacgggugacccuggacggcgagcucauggggacaacccaacugcuucccaaccagauuugugcguuccgcggaacgcugacaagaucuaccaaucgggccuccgaucaggcugacacagccaccccgcgccucuucgaccaccauuggcacauccagcuggauaaccuuaauggcaccccuuaugaccccgccgaggauauuccugcuccccugggcacaccugacuuuagagggaagguuuucggaguggccagccaacggaaccccgauuccacgacccgcgcgcacgaagcuaaagucgacacaaccucuggcagauuuacaccgaagcucgggagccuggagaucaccacggaauccgaugacuucgauccuaaucagagcacaaaguuuacccccgugggaauuggcguugacaacgaggccgauuuccagcaauggucucugcccgacuacuccgggcaguuuacccauaauaugaaccucgccccugcuguggccccgaauuuccccggagaacagcugcuguuuuuccggagccagcuuccuucuagcggcggcagauccaacgggauccucgacugccuggucccccaagagugggugcagcacuuuuaucaggagucugcuccugcccagacacaagucgcgcuugugcgcuacguuaaccccgauaccggacgggugcuguucgaagccaaacuccauaagcugggcuuuaugacaaucgcuaaaaauggggacagcccuauuacggugcccccgaacggauacuucagauucgaguccugggucaauccuuuuuauacccuggcccccaugggcacagggaacggccgccggagaauccaguga

SEQ ID NO: 28853 - RNA, 1647 nt, Artificial Sequence
  derived and/or modified sequence opt5 from VP1__Norovirus_and/or_Norovirus-like__U02030
augaagauggccagcaacgacgcugcccccuccaaugauggcgcggcuugccuggugccugagaucaacaaugaagccauggcccucgagccggucgcugggucugccauugcugcgccccugaccggacagcaaaacaucauugacccuuggaucaugaauaacuucguucaggcccccggcggggaauuuacagugagcccuagaaauucccccggagaggugcuucugaaccucgaacugggcccugagauuaauccguaccuugcccaccuggcuagaauguauaacggguacgccggaggcuucgagguccaggugguucucgcuggcaaugccuuuacggcggggaaaaucaucuucgccgcuauucccccuaacuuucccaucgauaaucugucugccgcucagauuaccauguguccucaugugaucgucgacgugcgccaacuggaacccauuaaccucccgaugccugauguuagaaauaacuucuuucacuauaaccagggaagcgacucccggcugcgccuuaucgccaugcuguacacaccccucagagccaauaacucuggcgaugacguguucaccgucagcugccgggugcugacacgcccuucccccgauuuuagcuucaauuuucuugugcccccuaccgucgagucuaagacaaaaccguucacccugcccauucucacgaucuccgaaaugagcaacucuagauuuccuguucccaucgacucccugcauaccagcccuacagagaauauuguggugcagugucagaacgggcgggucacccuggauggagagcucaugggcacaacccaacugcuucccucucagaucugcgcuuuccgcgggacgcugacaagauccaccagccgggcguccgaccaggccgauacaccgaccccucgccucuucaauuauuacuggcacauucagcuggacaaccuuaauggaacccccuaugacccugcugaagauauccccgccccucugggcacacccgacuuuagaggcaagguguucgggguugccucucaacggaacccggauagcacgacccgcgcucaugaggccaaaguggacacaaccuccggaagauuuacaccuaagcucggcagccuggaaauuaccacggagucugaugacuucgaucccaaucagcccacaaaguuuaccccugucggggugggaguugacaacgaagcggaguuccagcaauggucccugccgaauuacagcggccaguuuacccacaacaugaaucucgcucccgccguggccccuaacuuccccggggagcagcugcuguuuuuccggucucagcuuccuagcuccggaggcagaucuaacggcguccucgauugucuggugccccaagaauggguccagcacuuuuaccaggagagcgcuccugcccagacacaaguggcucuuguucgcuaugugaaucccgacaccgggcggguccuguucgaagccaaacuccauaagcugggauuuaugacaaucgcgaaaaacggcgauuccccgaucacggugccucccaauggguacuucagauucgagagcuggguuaacccuuuuuauacccuggcccccaugggaacaggcaaugggcgccggcggauucaguga

SEQ ID NO: 28854 - RNA, 1647 nt, Artificial Sequence
  derived and/or modified sequence opt5 from VP1__Norovirus_and/or_Norovirus-like__AB039782
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaucgauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaacuguucacccucccgauccugacgauuucugaaauguccaacagcagauuucccgugccuaucgacucucugcauaccucccccacagagaauaucgugguccagugccagaacggacgggugacccucgauggcgagcugauggggacaacccaacuucugccuagccagauuugugcguuccgcggaacgcucacaagaucuaccucccgggccagcgaccaggcugauacacccaccccgcgccuguucaaucacagauggcauauccagcuugacaaccugaauggcaccccuuaugaccccgccgaagauauuccugcuccccucggcacaccugacuuucgggggaagguuuucggaguggccucccaacgcaaccccgauucuacgaccagagcccacgaggcgaaagucgacacaaccagcggccgguuuacaccgaagcuggggucccuggaaaucaccacggagagcgaugacuucgauacaaaucagucuaccaaguuuaccccugugggaauuggcguugacaacgaagcugaguuccagcaauggucccuccccaauuacagcgggcaguuuacacacaacaugaaucuggcccccgccguggcuccuaacuucccgggagagcagcuucuguuuuucagaucucagcuccccagcuccggcggccgcucuaacgggguccuggauugccuugugccucaagaauggguccagcauuuuuaucaggagagcgcccccgcucagacccaaguggcccugguucgguacgugaauccugacacaggaagaguccucuucgaagcgaaacugcacaagcugggcuuuaugacgaucgccaaaaacggggauucccccaucaccgugccucccaauggauacuuccgcuucgagagcuggguuaacccguuuuauacacucgcuccuaugggcaccgggaauggccggagacgcauucaguga

SEQ ID NO: 28855 - RNA, 1647 nt, Artificial Sequence
  derived and/or modified sequence opt5 from VP1__Norovirus_and/or_Norovirus-like__U46039
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaucgauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguucacaccccucagagcuaauaacuccggggaugacgucuuuaccgugucuugucgggugcugacacgcccuagccccgauuucuccuuuaauuuccuugugcccccuaccguugagagcaagaucaaaccguuuacacugcccauucucccuaucucugaaauguccaacagcagauuccccgugccuaucgacucucugcauaccucccccacggagaauauugugguccagugccagaacggacgggugacccuggauggcgagcucauggggacaacccaacuguucccgagccagaucugugcguuucgcggaacacuuaccagaucuacgucccgggccagcgaccaggcugauacauccaccccucgccuguucaauuacuauuggcacauucagcucgacaaccugaauggcacacccuacgacccugccgaagauauccccgccccucuuggcacccccgacuuucaagggaagguuuucggaguggcuucucagagaaacccggauagcaccacacgggcccaugaggcgaaagucgacacgaccuccggccgcuuuacaccuaagcuggggagccucgaaauuucuaccgaguccgaugacuucgauagcaaucagcccacaaaguuuacccccgugggaaucggcguugacaacgaagcugauuuccaacaguggucucugccuaauuauagcgggcaguuuacgcacaacaugaaucuggccccggccguggcucccaucuucccuggagagcagauucucuuuuucagaucccaaguccccucuagcggcggccgguccaacggggugcuggacugccuugucccucaggagugggugcagcacuuuuaccaggaaagcgcccccgcucaaacacagguugcccuggugagauacgucaacccugauaccggacgcguccucuucgaggcgaaacugcauaaacuuggcuucaugaccaucgccaagaauggggacucucccauuacaguuccgccuaacggauauuuucgguucgaauccugggugaaucccuuuuacacccuggcuccuaugggcacagggaacggcagacgccggauccaguga

SEQ ID NO: 28856 - RNA, 1647 nt, Artificial Sequence
  derived and/or modified sequence opt5 from VP1__Norovirus_and/or_Norovirus-like__DQ093066
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaagugaucuucgcugccauucccccuaacuuucccaucgacaaucuguccgcugcccagaucaccaugugcccucaugucauuguggauguucgccaacuggagcccaucaaccucccgaugccugacgugagaaauaacuucuuucacuauaaccagggcucugauagccggcugcgccuuauugccaugcuguacacaccccucagagcuaauaacuccggggacgaugucuucaccgugucuugucgggugcugacacgcccuagccccgacuuuuccuucaauuuucuuguucccccuaccgucgaaagcaagacaaaaccguucacccugcccauccucacgauuucugagauguccaacagcagauuuccugugcccaucgauucucugcauaccuccccuacagaaaauaucgugguccagugccagaacggacgggugacccuggacggcgagcucauggggacaacccaacugcuucccagccagauuuguacguuccgcggaacacugaccagaucuacaucccgggcgagcgaucaggccgacaccgcuaccccgcgccucuucaauuauuacuggcacauccagcuggacaaccuuaauggcacaccuuaugaucccgccgaggacauuccugcuccccugggcacgccugauuuuagagggaagguuuucggaguggccucccaacggaaccccgacucuaccacacgcgcccaugaagcgaaagucgauaccacaagcggcagauuuaucccgaagcucgggucccuggagauuagcaccgaaucugacgauuucgaccagaaucagccuacgcgguuuacacccgugggaaucggcguugauaacgaggcuggguuccaacaguggucccugcccgacuacagcggacaguuuacccacaauaugaaccucgccccugccguggcuccgaauuuccccggcgaacagcugcuguuuuucagaucucaacuuccuagcuccggcgggcgcucuaacggaauccucgauugccuggucccccaggagugggugcagcacuuuuaccaggagagcgccccugcucaaacccaggucgcccuugugcgguauguuaaccccgacacaggcagagugcuguucgaagcgaagcuccauaaacugggguuuaugaccauuuccaagaauggagacagcccuaucacagugcccccgaacggcuacuuccgcuucgagucuugggucaauccuuuuuauacgcuggcccccauggggaccggcaacggacggagacgcauucaguga

SEQ ID NO: 28857 - RNA, 1647 nt, Artificial Sequence
  derived and/or modified sequence opt5 from VP1__Norovirus_and/or_Norovirus-like__DQ093062
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccauugauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaacuguucacccucccgauccugacgauuucugaaauguccaacagcagauuucccgugccuaucgacucucugcauaccucccccacagagaauaucgugguccagugccagaacggacgggugacccucgauggcgagcugauggggacaacccaacuucugccuagccagauuugugcguuccgcggaacgcucacaagacccaccucucgggccuccgaccaggcugauacaccgaccccucgccuguucaaucacagauggcauauccagcuugacaaccugaauggcacccccuaugacccugccgaagauauucccgccccucucggcacacccgacuuucgggggaagguuuucggaguggcuagccaacgcaacccggauuccacgaccagagcccacgaggcgaaagucgacacaaccucuggccgguuuacaccuaagcuggggagccuggaaaucaccacggaguccgaugacuucgauacaaaucagagcaccaaguuuacccccgugggaauuggcguugacaacgaagcugaguuccagcaauggucucuccccaauuacuccgggcaguuuacacacaacaugaaucuggccccugccguggcuccgaacuuccccggagagcagcuucuguuuuucagaagccagcucccuucuagcggcggccgcuccaacgggguccuggauugccuugugccccaagaauggguccagcauuuuuaucaggagucugccccugcucagacccaaguggcccugguuaaauacgugaaucccgacacaggacggguccucuucgaagcgaagcugcacaaacugggcuuuaugacgaucgccaagaacggggauagcccuaucaccgugcccccgaauggauacuucagauucgaguccuggguuaacccuuuuuauacacucgcucccaugggcaccgggaauggccgccggagaauccaguga

SEQ ID NO: 28858 - RNA, 1647 nt, Artificial Sequence
  derived and/or modified sequence opt5 from VP1__Norovirus_and/or_Norovirus-like__GU930737
augaagauggccagcaacgacgcugcccccuccaaugauggcgcggcuaaccuggugccugaggccaauucugaagucauggcccucgagccgguugugggggcuagcaucgccgcucccguggucggacagcaaaacauuaucgacccuuggauuagagaaaauuucgugcaggcgccccagggcgaguuuaccguuuccccucggaacucucccggggaaaugcugcuuaaucuggagcucggaccugagcugaacccguaccuuagccaccugucccgcauguauaauggcuacgccgggggaaugcaagugcaggucgugcucgccggcaacgcuuucacagccggcaagaucauuuuugcugccguucccccucauuuccccguggaaaauaucucugcggcccagaucacgaugugcccucacgucauuguggaugugagacagcuggagcccguccugcucccgcugccugacauccggaaccgcuuuuuccauuauaaucaggaagauacccccagaaugcggcuuguugcuaugcuguacacaccucuccgcgccaacagcggggaggacguguuuaccguguccuguagaguccugacacggcccgcucccgauuucgaguuuaccuuccuugugccuccgacaguugaaagcaagaccaaacccuuuacgcugccuauucucacccugggagagcugucuaauucccgcuuccccgccccuaucgacaugcucuauacagaucccaacgaagccauugugguccaaccgcagaacggcagaugcacccuggacgggacacuucagggaaccacgcagcuggugccuacacaaaucuguagcuuucggggcacccucauuucucagacaucccgcagcgcugauucuaccgacuccgcgcccagaguucggaaucacccucugcaugugcagcuuaagaaccuggaugggacccccuacgacccuacagacgagguccccgccgugcucggagcuaucgauuucaaaggcacggucuucggcguggccagccaacgcaauaccacagggaacuccgaagagggagccaccagagcucacgagguucacaucgacacaaccaauccgcgguauacgccuaagcugggcucuguguuuaugcauagcgaauccacagauuucgacgaugggcagcccaccagauuuacccccauuggaaugggcgccgacgauuggcgccagugggagcugccugaauacagcgggcaccucacacugaacaugaaucuugcgccggcugucgcccccgccuucccuggagagcggauccuguuuuucagaucugugguucccuccgcuggcggcuacgggagcggacagauugacugccucaucccucaagaaugggugcagcauuuuuaucaggaggccgcucccucucagagcgccgucgcgcugauucgcuacgugaacccugauaccggccggaauaucuucgaggccaaacuucacagagaaggguuuaucacaguggcuaacuccggaaauaaccccauuguugucccgccuaauggcuauuuccgcuuugaggccugggugaaccaauucuacacgcugacccccauggggacaggccagggacggagacgcgugcaguga

SEQ ID NO: 28859 - RNA, 1647 nt, Artificial Sequence
  derived and/or modified sequence opt5 from VP1__Norovirus_and/or_Norovirus-like__AF414412
augaagauggccagcaacgacgcugcccccuccucugauggcgcggcugggcuggugccugagaucaauaacgaagccauggcccucgagccggucgcuggagccgcuauugccgcgccccugaccggccagcaaaauaucauugacccuuggaucaugaacaauuucguucaggcccccgggggagaauuuacagugagcccuagaaacucccccggcgaggugcuucugaaucucgaacuggggccugagauuaacccguaccuugcucaccuggcccggauguauaauggauacgcuggcggcuucgagguccaggugguucucgccgggaacgcguuuacggccggaaaagugaucuucgcugccauucccccuaauuuucccaucgauaaccugucugcugcccagaucaccaugugcccucaugucauuguggacguucgccaacuggaacccaucaaucucccgaugccugaugugagaaacaauuucuuucacuauaaccagggcagcgacucccggcugcgccuuauugccaugcuguacacaccccucagagcuaacaauucuggggaugacgucuucaccgugagcugucgggugcugacacgcccuucccccgauuuuagcuucaacuuucuuguucccccuaccgucgagucuaagacaaaacuguucacccucccgauccugacgauuuccgaaaugagcaauucuagauuucccgugccuaucgacucccugcauaccagccccacagagaacaucgugguccagugccagaauggacgggugacccucgauggcgagcugauggggacaacccaacuucugccuucucagauuugugcguuccgcggaacgcucacaagauccaccagccgggccuccgaccaggcugauacacccaccccgcgccuguucaacuauuacuggcacauccagcuugacaaucugaacggcaccccuuaugaccccgccgaagauauuccugcuccccucggcacaccugacuuuagagggaagguuuucggaguggccucucaacggaaucccgauagcacgacccgcgcccaugaggcgaaagucgacacaaccuccggcagauuuacaccgaagcuggggagccuggaaaucucuaccgaguccgaugacuucgauccuaaccagcccacgaaguuuacacccgugggaauuggcguugacaaugaagcugauuuccagcaauggagccucccuaacuacucugggcaguuuacccacaauaugaaccuggccccggccguggcucccaauuucccuggagagcagcuucuguuuuuccggagccagagacccuccucuggcggccgcagcaacgggauccucgacugccuggucccucaagagugggugcagcacuuuuaccaggaauccgcccccgcucagacccaagucgcccuugugcgguauguuaacccugauacaggaagagugcuguucgaggcgaaacuccauaagcugggcuuuaugaccaucgccaaaaauggggacagccccauuacagucccgccuaacggauacuuccgcuucgaaucuugggugaaucccuuuuauacgcuggcuccuaugggcaccgggaacggccggagacgcauccaguga

SEQ ID NO: 28860 - RNA, 1647 nt, Artificial Sequence
  derived and/or modified sequence opt5 from VP1__Norovirus_and/or_Norovirus-like__AB039781
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaucgauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaacuguucacccucccgauccugacgauuucugaaauguccaacagcagauuucccgugccuaucgacucucugcauaccucccccacagagaauaucgugguccagugccagaacggacgggugacccucgauggcgagcugaugggggcgacacaacuucugccuagccagauuugugccuuccgcggaacccucacgagaucuacaucccgggcuagcgaccagaccgauacacccaccccgcgccuguucaaucacagauggcauauccagcuugacaaccugaauggcaccccuuaugaccccgccgaagauauuccugcuccccucggcacaccugacuuucgggggaagguuuucggaguggccucccaacgcaaccccgauucuacgaccagagcccacgaggcgaaagucgacacaaccagcggccgguuuacaccgaagcuggggucccuggaaaucaccacggagagcgaugaccucgauacaaaucagucuaccaaguucaccccugugggaauuggcguugacaacgaagcugaguuucagcaauggucccugcccaauuacagcgggcaguucacacacaacaugaaucuugcccccgccguggcucugaacuuuccuggagagcagcuccuguucuuuagaucucagcuuccgagcuccggcggccgcucuaacgggguccuggauugccucgugccccaagaauggguccagcauuucuaucaggagagcgccccugcucagacccaaguggcccugguucgguacgugaaucccgacacaggaagaguccuguuugaagcgaaacuccacaagcugggcuucaugacgaucgccaaaaacggggauuccccuaucaccgugcccccuaauggauacuuucgcuucgagagcuggguuaaccccuucuauacacuugcuccgaugggcaccgggaauggccggagacgcauucaguga

SEQ ID NO: 28861 - RNA, 1647 nt, Artificial Sequence
  derived and/or modified sequence opt5 from VP1__Norovirus_and/or_Norovirus-like__LC035073
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagccaauaacuccggggacgaugucuucaccgugucuugucgggugcugacccgcccuagccccgaauuuuccuucaauuuucuuguucccccuacagucgagagcaagaccaaaccguucacgcugcccauccucaccauuucugaaauguccaacagcagauuuccugugcccaucgacucucugcauacauccccuaccgagaauaucgugguccagugccagaacggacgggugacacuggauggcgagcucauggggaccacgcaacugcuucccagccagauuugugcuuuccgcggaguucugacaagaucuaccucccgggcgagcgaccaggccgauacagcuaccccgcgccucuucaauuauuacuggcacauccagcuggacaaccuuaauggcaccccuuaugaccccgccgaagauauuccuggcccccuggggacaccugacuuuagaggaaagguguucggcgucgccucccaacggaaccccgauucuacgacccgcgcucaugaggccaaaguggacacaaccagcgggagauuuacaccgaagcucggaucccuggaaaucagcaccgagucugaugacuucgaucagaaucagccuacgcgguuuacacccguuggcauugggguggaccacgaagcggauuuccaacaguggucccugcccgacuacagcggacaguuuacccacaacaugaaucucgcuccugccgucgccccgaacuuccccggcgagcagcugcuguuuuucagaucucaacuuccuagcuccggcgggcgcucuaauggaauccucgauugccuggugccccaggaguggguccagcauuuuuaccaggaaagcgcuccugcccaaacccagguggcucuuguucgguaugugaaccccgacacaggcagaguccuguucgaggccaagcuccacaaacugggguuuaugaccaucgcgaagaacggagacuccccuauuacagugcccccgaauggcuacuuccgcuucgaaagcuggguuaacccuuuuuauacgcuggcccccauggggaccggcaauggacggagacgcgugcaguga

SEQ ID NO: 28862 - RNA, 1647 nt, Artificial Sequence
  derived and/or modified sequence opt5 from VP1__Norovirus_and/or_Norovirus-like__AF539440
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagccaauaacuccggggacgaugucuucaccgugucuugucgggugcugacccgcccuagccccgacuuuuccuucaauuuucuuguucccccuacagucgaaagcaagaccaaaccguucacgcugcccauccucaccauuucugagauguccaacagcagauuuccugugcccaucgauucucugcauacauccccuaccgaaaauaucgugguccagugccagaacggacgggugacacuggacggcgagcucauggggaccacgcaacugcuucccagccagauuugugcuuuccgcggaguucugacaagaucuaccucccgggcgagcgaucaggccgacacagcuaccccgcgccucuucaauuauuacuggcacauccagcuggacaaccuuaauggcaccccuuaugaucccgccgaggacauuccuggcccccuggggacaccugauuuuagaggaaagguguucggcgucgccucccaacggaaccccgacucuacgacccgcgcucaugaagccaaaguggauacaaccgcggggagauuuacaccgaagcucggaagccuggagaucuccaccgaaagcgacgauuucgaccagaaucagccuacgcgguuuacacccguuggcgugggggucgaucacgaggcugacuuccaacaguggucucugcccgauuacuccggacaguuuacccacaacaugaaucucgccccugccguggcuccgaacuuccccggcgaacagcugcuguuuuucagaagccaacuuccuucuagcggcgggcgcuccaauggcauucucgacugccuggucccccaggagugggugcagcauuuuuaccaggagucugccccugcucaaacccagguugcccuugugcgguaugucaaccccgacacaggaagagugcuguucgaagcgaagcuccacaaacugggguuuaugaccaucgccaagaacggagauagcccuaucacaguucccccgaauggcuacuuccgcuucgaguccugggugaacccuuuuuauacgcuggcucccauggggaccggcaauggacggagacgcauucaguga

SEQ ID NO: 28863 - RNA, 1647 nt, Artificial Sequence
  derived and/or modified sequence opt5 from VP1__Norovirus_and/or_Norovirus-like__AF414414
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaucgauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaacuguucacccucccgauccugacgauuucugaaauguccaacagcagauuucccgugccuaucgacucucugcauaccucccccacagagaauaucgugguccagugccagaacggacgggugacccucgauggcgagcugauggggacaacccaacuucugccuagccagauuugugcguuccgcggaacgcucacaagaucuaccucccgggccagcgaccaggcugauacacccaccccgcgccuguucaaucacagauggcauauccagcuugacaaccugaauggcaccccuuaugaccccgccgaagauauuccugcuccccucggcacaccugacuuucgggggaagguuuucggaguggccucccaacgcaaccccgauucuacgaccagagcccacgaggcgaaagucgacacaaccagcggccgguuuacaccgaagcuggggucccuggaaaucauuaccgagagcgaugacuucgauacgaaucagucuacaaaguuuaccccugugggaaucggcguugacaacgaauccgaguuccagcaauggagccuccccaauuacucugggcaguuuacccacaacaugaaucuggcucccgccguggccccuaacuuccuuggagagcagcugcucuuuuucagaagccagcugccguccucuggcggccgcagcaacgggguccuugauugccuggugccccaagaauggguccagcauuuuuaucaggaguccgcuccugcccagacacaaguggcucucguucgguacgugaaucccgacaccggaagaguccuguucgaagccaaacugcacaagcucggcuuuaugacaaucgcgaaaaacggggauagcccuauuacggugcccccuaauggauacuuccgcuucgagucuuggguuaaccccuuuuauacccuggccccgaugggcacagggaauggccggagacgcauccaguga

SEQ ID NO: 28864 - RNA, 1647 nt, Artificial Sequence
  derived and/or modified sequence opt5 from VP1__Norovirus_and/or_Norovirus-like__AB190457
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagccaauaacuccggggacgaugucuucaccgugucuugucgggugcugacccgcccuagccccgacuuuuccuucaauuuucuuguucccccuacagucgaaagcaagaccaaaccguucacgcugcccauccucaccauuucugagauguccaacagcagauuuccugugcccaucgauucucugcauacauccccuaccgaaaauaucgugguccagugccagaacggacgggugacacuggacggcgagcucauggggaccacgcaacugcuucccagccagauuugugcuuuccgcggaguucugacaagaucuaccucccgggcgagcgaucaggccgacacagcuaccccgcgccucuucaauuauuacuggcacauccagcuggacaaccuuaauggcaccccuuaugaucccgccgaggacauuccuggcccccuggggacaccugauuuuagaggaaagguguucggcgucgccucccaacggaaccccgacucuacgacccgcgcucaugaagccaaaguggauacaaccgcggggagauuuacaccgaagcucggaagccuggagaucuccaccgaaagcggcgacuucgaucagaaucagccuacgcgguuuacacccguugggauuggaguggacaacgaggcugauuuccaacaguggucucugcccgacuacuccggccaguuuacccacaauaugaaccucgccccugccgucgcuccgaauuuccccggcgaacagcugcuguuuuucagaagccaacuuccuucuagcgggggacgcuccaacggcauccucgauugccuggugccccaggaguggguccagcacuuuuaccaggagucugccccugcucaaacccagguggcccuuguucgguaugugaaccccgacacagggagaguccuguucgaagcgaagcuccauaaacugggauuuaugaccaucgccaagaauggcgacagcccuauuacagugcccccgaacggguacuuccgcuucgaguccuggguuaauccuuuuuauacgcuggcucccaugggcaccggaaacggccggagacgcauccaguga

SEQ ID NO: 28865 - RNA, 1647 nt, Artificial Sequence
  derived and/or modified sequence opt5 from VP1__Norovirus_and/or_Norovirus-like__AF425768
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagccaauaacuccggggacgaugucuucaccgugucuugucgggugcugacccgcccuagccccgacuuuuccuucaauuuucuuguucccccuacagucgaaagcaagaccaaaccguucacgcugcccauccucaccauuucugagauguccaacagcagauuuccugugcccaucgauucucugcauacauccccuaccgaaaauaucgugguccagugccagaacggacgggugacacuggacggcgagcucauggggaccacgcaacugcuucccagccagauuugugcuuuccgcggaguucugacaagaucuaccucccgggcgagcgaucaggccgacacagcuaccccgcgccucuucaauuauuacuggcacauccagcuggacaaccuuuccggcaccccuuaugaucccgccgaggacauuccuggcccccuggggacaccugauuuuagaggaaagguguucggcgucgccucucaacggaaucccgacagcacgacccgcgcucaugaagccaaaguggauacaaccgcggggagauuuacaccgaagcucggaucccuggagaucagcaccgaaucugacgauuucgaccagaaccagccuacgcgguuuacacccguuggcgugggggucgaucacgaggcugacuuccaacaguggucccugcccgauuacagcggacaguuuacccacaauaugaaccucgccccugccguggcuccgaauuuccccggcgaacagcugcuguuuuucagaucucaacuuccuagcuccggcgggcgcucuaacggcauucucgacugccuggucccccaggagugggugcagcauuuuuaccaggagagcgccccugcucaaacccagguugcccuugugcgguaugucaaucccgacacaggaagagugcuguucgaagcgaagcuccacaaacugggguuuaugaccaucgccaagaacggagauuccccuaucacaguucccccgaacggcuacuuccgcuucgagagcugggugaauccuuuuuauacgcuggcucccauggggaccggcaacggacggagacgcauucaguga

SEQ ID NO: 28866 - RNA, 1647 nt, Artificial Sequence
  derived and/or modified sequence opt5 from VP1__Norovirus_and/or_Norovirus-like__AF414415
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggccgugcucgcggggaaugccuuuacggcuggaaaaguuaucuucgccgcuauucccccuaacuuucccaucgauaaucuguccgccgcccagaucaccaugugcccucaugugauugucgacgugcgccaacuggaacccaucaaccucccgaugccugauguuagaaauaacuucuuucacuauaaccagggcucugacagccggcugcgccuuauugcuaugcuguacacaccccucagagcgaauaacuccggggaugacguguucaccgucucuugucgggugcugacacgcccuagccccgauuuuuccuucaauuuucuugugcccccuaccgucgagagcaagacaaaacuguucacccucccgauccugacgauuucugaaauguccaacagcagauuucccguuccuaucgacucucugcauaccucccccacagagaauaucguggugcagugccagaacggacgggucacccucgauggcgagcugauggggacaacccaacuucugccuagccagauuugugccuuccgcggaacgcucacaagaucuaccucccgggcuagcgaccaggccgauacacccaccccgcgccuguucaaucacagauggcauauccagcuugacaaccugaauggcaccccuuaugaccccgccgaagauauuccugcuccccucggcacaccugacuuucgggggaagguguucggaguugccucccaacgcaaccccgauucuacgaccagagcgcacgaggcuaaaguggacacaaccagcgaucgguuuacaccgaagcugggcucccuggaaaucauuaccgagagcggggacuucgauacgaaucagucuacaaaguuuaccccugucggaaucggcguggacaacgaagccgaguuccagcaauggucccuccccaauuacagcgggcaguuuacccacaacaugaaucuggcccccgcuguugccccuaacuucccgggagagcagcuucuguuuuucagaucucagcuccccagcuccggcggccgcucuaacggggugcuggauugccuugucccucaagaaugggugcagcauuuuuaucaggagagcgcucccgcccagacacaagucgcgcuggugcgguacguuaauccugacaccggaagaguccucuucgaagccaaacugcacaagcugggcuuuaugacaaucgcuaaaaacggggauucccccauuacggugccucccaauggauacuuccgcuucgagagcugggugaacccguuuuauacccucgccccuaugggcacagggaauggccggagacgcauccaguga

SEQ ID NO: 28867 - RNA, 1647 nt, Artificial Sequence
  derived and/or modified sequence opt5 from VP1__Norovirus_and/or_Norovirus-like__KT779557
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaagugaucuucgcugccauucccccuaacuuucccaccgacaaucuguccgcugcccagaucacaaugugcccucaugucaucguggauguucgccaacuggagcccauuaaccucccgaugccugacgugagaaauaacuucuuucacuauaaccagggcucugauagccggcugcgccuuaucgccaugcuguacacaccccucagagcuaauaacuccggggacgaugucuucaccgugucuugucgggugcugacccgcccuagccccgacuuuuccuucaauuuucuuguucccccuacagucgaaagcaagauuaaaccguucacccugcccauccucacgauuucugagauguccaacagcagauuuccugugcccaucgauucucugcauaccuccccuacagacaauaucgugguccagugccagaacggacgggugacccuggauggcgaacucauggggacaacccaacugcuucccagccagauuugugcguuccgcggaguucugacgagaucuacaucccgggccagcgaccaggcugacgccgccaccccgcgccucuucaauuaucacuggcauauccagcuggauaaccuuaauggcacaccuuacgaccccgcugaggauauuccugcgccccugggcaccccugacuuuagagggaagguguucggagucgccucccaacggaaccccgauucuaccacacgcgcucacgaggccaaaguggacacgaccagcggcagauuuacaccgaagcucgggucccuggaaaucagcaccgagucuggagauuucgaccagaaucagccuauucgguuuacacccguuggcaucgggguggauaacgaagccgacuuccaacaguggacccugcccgauuauuccggacaguuuacgcacaauacaaaccucgcuccugccgucgcuccgaauuuccccggcgagcagcugcuguuuuucagaagccaacuuccuucuagcggcgggcgcuccaacggaauccucgacugccuggugccccaggaauggguccagcauuuuuaccaggagucugccccugcgcaaacccagguggcccuuguucgguacgugaaccccgacaccggcagaguccuguucgaggcuaagcuccacaaacugggguauaugacaauugccaagagcggagauuccccuaucaccgugcccccgaauggcuacuuucgcuucgaaagcuggguuaacccuuucuauacacuggcucccauggggacgggcaauggacggagacgcauucaguga

SEQ ID NO: 28868 - RNA, 1647 nt, Artificial Sequence
  derived and/or modified sequence opt5 from VP1__Norovirus_and/or_Norovirus-like__AY247432
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagccaauaacuccggggacgaugucuucaccgugucuugucgggugcugacccgcccuagccccgacuuuuccuucaauuuucuuguucccccuacagucgaaagcaagaccaaaccguucacgcugcccauccucaccauuucugagauguccaacagcagauuuccugugcccaucgauucucugcauacauccccuaauggaaacuucgugguccagugccagaauggccgggugacccuggacggggaacucaugggaacaacccaacugcuucccagccagaucugugcuuuccgcggcguucugacgagacaggugucucgggcgggcgaucagauugacacagccaccccgcgcuccuuugggaaccacuggcauauccaacucgacaaucugaacggaacaccuuaugaucccgcugaggacauuccuggcccccuugggaccccugauuuccagggaaucgucuuuggcguggccagccagagaaauuccgacgggaccacacgggcccacgaggcuaagguugauacgcgcaccggaagauucacacccaaacugggcucucucgugauuagcaccgacuccgaagauuuucaacagaacaagccgacacgguucaccccugucggcgugggggucgacagcgaggaagaguuugaucaguggucucugcccgacuacuccggacccaucacgcacaauaugaaccuggccccugcgguggcuccgaauuuccccggcgaacagcuccuguuuuucagaagccaacuuccuucuagcgggggaaucuccaagggcauucuggauugccucguuccccaggagugggugcagcauuuuuaucaggagucugccccugcccaaacacaggucgcucuggugcgcuacguuaaccccgacaccgggcgggugcuuuucgaagccaaacugcacaagcucggcuuuaugaccaucgcuaaagacggagauagcccuauuacagugcccccgaacggcuacuucagauucgaguccugggucaauccuuuuuauacccuggcccccauggggacaggaaacggccgccggagaauccaguga

SEQ ID NO: 28869 - RNA, 1647 nt, Artificial Sequence
  derived and/or modified sequence opt5 from VP1__Norovirus_and/or_Norovirus-like__AF414411
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggcuugagauuaauccuuaccuggcucaccucgcccggauguauaacggauacgcuggcgucuucgaggugcagguugugcuggccggcaaugcguuuacggccgggaaagucaucuucgcugccaucccgcccaacuuuccuauugauaaucuguccgcugcccagaucaccaugugcccccaugugauuguugacgugcgccaacucgaaccuaucaaccugcccaugccggaugucagaaauaacuucuuucacuauaaccagggaucugacagccggcuucgccugauugccaugcucuacacaccucugagagcuaauaacuccggcgaugacguguucaccgugucuugucggguccuuacacgccccagcccugauuuuuccuucaauuuucugguuccucccaccguggagagcaagacaaaacucuucacccugcccauccugacgauuucugaaauguccaacagcagauuuccggugcccaucgacucucuccauaccuccccuacaaagaauaucgucgugcagugccagaacgggcggguuacccuggauggagagcuuaugggcacaacccaacugcuccccagccagauuugugcguuccgcgggacgcugacaagaucuaccucccgggccagcgaccaggcugauacaccuacaccccgccuuuucggacacagauggcauauccagcuggacaaucucaacggcaccccguaugacccugccgaggauauucccgccccucugggcacccccgacuuucgggggaaaguguucggagucgcuucccaacgcaauccugauucuacgaccagagcccacgaagcgaagguggacacaaccagcggccgguuuacacccaagcuggggucccucgagaucauuaccgaaagcgaugacuucgauacgaaccagucuacaaaauuuaccccgguuggaaucggcguggacaaugaggcugaguuccagcaauggucccugccuaacuacagcgggcaguuuacccacaauaugaaccuugcccccgccgucgcucccaauuucccuggagaacagcugcucuuuuucagaucucagcugccgagcuccggcggccgcucuaacggggugcuugauugccuggucccccaagagugggugcagcauuuuuaucaggaaagcgccccugcucagacacaaguugcccucgugcgguacgucaaccccgacaccggaagagugcuguucgaggcgaagcugcacaaacucggcuuuaugacaaucgccaagaauggggauuccccuauuacgguucccccuaacggauacuuccgcuucgaaagcugggugaaucccuuuuauacccuggcuccgaugggcacagggaacggccggagacgcauccaguga

SEQ ID NO: 28870 - RNA, 1647 nt, Artificial Sequence
  derived and/or modified sequence opt5 from VP1__Norovirus_and/or_Norovirus-like__AJ277617
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucgcccaggcucccgggggagaauuuacaguuucuccuagaaauagccccggcgaggugcuucugaaccucgaacuggggccugagauuaauccguaccuugcccaccuggcucggauguauaacggauacgccggcggcuucgaggugcaggucgugcucgcggggaaugccuuuacggcuggaaaaguuaucuucgccgcuauucccccuaacuuucccaucgauaaucuguccgccgcccagaucaccaugugcccucaugugauugucgacgugcgccaacuggaacccaucaaccucccgaugccugauguuagaaauaacuucuuucacuauaaccagggcucugacagccggcugcgccuuauugcuaugcuguacacaccccucagagcgaauaacuccggggaugagguguucaccgucucuugucgggugcugacacgcccuagccccgacuuuuccuucaauuuucuugugcccccuaccgucgaaagcaagacaaaacuguucacccucccgauccugacgauuucugagauguccaacagcagauuucccguuccuaucgauucucugcauaccucccccacagagaauaucguggugcagugccagaacggacgggucacccucgacggcgaacugauggggacaacccaacuucugccuagccagauuugugccuuccgcggaacgcucacaagaucuaccucccgggcuagcgaucaggccgacacacccaccccgcgccuguucaaucacagauggcauauccagcuugauaaccugaauggcaccccuuaugaccccgccgaggacauuccugcuccccucggcacaccugauuuucgggggaagguguucggaguugccucccaacgcaaccccgacucuacgaccagagcgcacgaagcuaaagccgauacaaccagcggccgguuuacaccgaagcuggggucccuggagaucauuaccgaaagcgacgauuucgacacgaaucagucuacaaaguuuaccccugugggaaucggcgucgauaacgaggccgaguuccagcaauggucccuccccaauuacagcgggcaguuuacccacaacaugaaucuggcucccgccguggcuccuaacuucccgggagaacagcuucuguuuuucagaucucagcuccccagcuccggcggccgcucuaacgggguucuggacugccuuaucccucaagagugggugcagcauuuuuaucaggaaagcgcccccgcgcagacacaagucgcccuggugcgguacgucaauccugauaccggaagaguucucuucgaggcuaaacugcacaagcugggcuuuaugacaauugccaaaaacggggacucccccaucacggugccucccaauggauaccuccgcuucgaaagcugggugaacccguucuauacccuggcuccuaugggcacagggaauggccggagacgcauucaguga

SEQ ID NO: 28871 - RNA, 1647 nt, Artificial Sequence
  derived and/or modified sequence opt5 from VP1__Norovirus_and/or_Norovirus-like__LC036561
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagccaauaacuccggggacgaugucuucaccgugucuugucgggugcugacccgcccuagccccgaauuuuccuucaauuuucuuguucccccuacagucgagagcaagaccaaaccguucacgcugcccauccucaccauuucugaaauguccaacagcagauuuccugugcccaucgacucucugcauacauccccuaccgagaauaucgugguccagugccagaacggacgggugacacuggauggcgagcucauggggaccacgcaacugcuucccagccagauuugugcuuuccgcggaguucugacaagaucuaccucccgggcgagcgaccaggccgauacagcuaccccgcgccucuucaauuauuacuggcacauccagcuggacaaccuuaauggcaccccuuaugaccccgccgaagauauuccuggcccccuggggacaccugacuuuagaggaaagguguucggcgucgccucccaacggaaccccgauucuacgacccgcgcucaugaggccaaaguggacacaaccagcgggagauuuacaccgaagcucggaucccuggaaaucagcaccgagucuggcgauuucgaccagaaucagccuacgcgguuuacacccguugggauuggaguggaucacgaagcggacuuccaacaguggucccugcccgauuacagcggccaguuuacccacaacaugaaucucgcuccugccgucgccccgaacuuccccggcgagcagcugcuguuuuucagaucucaacuuccuagcuccgggggacgcucuaauggcauccucgacugccuggugccccaggaguggguccagcauuuuuaccaggaaagcgcuccugcccaaacccagguggcucuuguucgguaugugaaccccgauacagggagaguccuguucgaggccaagcuccacaaacugggauuuaugaccaucgcgaagaacggcgacuccccuauuacagugcccccgaauggguacuuccgcuucgaaagcuggguuaacccuuuuuauacgcuggcccccaugggcaccggaaauggccggagacgcgugcaguga

SEQ ID NO: 28872 - RNA, 1647 nt, Artificial Sequence
  derived and/or modified sequence opt5 from VP1__Norovirus_and/or_Norovirus-like__KT732274
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuugucgccaugcuguacacaccccucagagccaauaacuccggggacgauguguucaccgugucuugucggguccugacccgcccuagccccgaauuuuccuucaauuuucuuguucccccuacaguggagagcaagaccaaacuguucacgcucccgauucugaccaucucugaaauguccaacagcagauuucccgugccuauugacucucugcauacaucccccaccgagaauaucgucgugcagugccagaacggacggguuacacucgauggcgagcugauggggaccacgcaacuucugccuagccagaucugugcuuuccgcggagugcucacaagaucuaccucccgggcgagcgaccaggccgauacagcuacaccccgccuguucaauuauuacuggcacauucagcuugacaaccugaauggcaccccguaugacccugccgaagauauccccggcccucucgggacccccgacuuuagaggaaaggucuucggcguggccucccaacggaacccugauucuacgacccgcgcucaugaggccaaaguugacacaaccagcgggagauuuacacccaagcugggaucccuggaaauuagcaccgagucuggcgauuucgaccagaaucagccgacgcgguuuacaccuguggggaucggagucgauuccgaagcggacuuccaacaguggagccuccccgauuacucuggccaguuuacccacaacaugaaucuggcucccgccguggccccuaacuucccgggcgagcagcuucuguuuuucagaagccaacuccccuccucugggggacgcagcaauggcauucuggacugccuugucccucaggagugggugcagcacuuuuaccaggaauccgcucccgcccaaacccagguugcucuggugcgguaugucaacccugauacagggagaguucucuucgaggccaagcugcauaaacugggauuuaugaccaucgcgaagaacggcgacagccccaucacagugccucccaauggguacuuccgcuucgaaucuugggugaacccguuuuauacgcucgccccuaugggcaccggaaauggccggagacgcguccaguga

SEQ ID NO: 28873 - RNA, 1647 nt, Artificial Sequence
  derived and/or modified sequence opt5 from VP1__Norovirus_and/or_Norovirus-like__AY247439
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaaaucaucuucgcugccauucccccuaacuuucccaucgacaaucuguccgcugcccagauuaccaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagcuaauaacuccggggacgaugucuucaccgugucuugucgggugcugacacgcccuagccccgacuuuuccuucaauuuucuuguucccccuaccgucgaaagcaagacaaaaccguucacccugcccauccucacgauuucugagauguccaacagcagauuuccugugcccaucgauucucugcauaccuccccuaauaacaauuucgugguccagugccagaacggacgggugacacuggacggcgaacucauggggaccacacaacugcuucccagccagaucugugcguuccgcggaguucuggccagacagauuaaucgggcuggcgaucagaucgacaccacgacaccgcgcucuuuugaccaccauuggcacauucaacucgauaaccugaauggcaccccuuaugaccccgccgaggauaucccugggccccuuggaacaccuggcuucaaggggauuguguuuggagucgccucccagagaaacagcgacggcaccacccgggcucacgaggccaaaguggauacacgcacggggagauucacccccaagcugggaucccucguuaucucuacagacagcgaagauucccagcaaaauaagccgacccgguuuacaccugugggcgucggcguggacaacgaggaagaguucgaucaguggagccugcccaauuacucugggcccaucacccauaacaugaaccuggcgccugcugucgccccgaauuuucccggagaacagcuccuguucuuuagaucccagcuuccuagcucuggcgggacgagcaaaggcauucuggacugccucgugccccaagaguggguucagcacuucuaucaggaguccgccccugcucagacacaaguggcccugguccgcuacgugaaccccgauaccggacggguucuuuuugaagcuaagcugcauaaacucggguucaugaccaucgccaaggacggcgacucuccuauuacagugcccccgaauggauacuuuagauucgagagcugggucaacccuuucuauacccuggcgcccaugggcacagggaauggacgccggagaauccaguga

SEQ ID NO: 28874 - RNA, 1647 nt, Artificial Sequence
  derived and/or modified sequence opt5 from VP1__Norovirus_and/or_Norovirus-like__AF539439
augaagauggccagcuccgacgcuacccccucuaacgauggcgccgcggggcuggugccugagaucaauaacgaagcuauggcccucgacccggucgccggagcugccauugcugcgccccugacaggccagcaaaauaucauugauccuuggaucaugaacaauuucguucaggcccccgggggagaguuuacggugagcccuagaaacucccccggcgaacuucugcucaaucuggagcuugggccugaaauuaacccguaccuggcccaccucgcucggauguauaauggauacgccggcggcuucgaggugcaggucgugcuggcugggaacgccuuuaccgcgggaaaaaucaucuucgccgcuauucccccuaauuuucccaucgacaaccugucugccgcucagauuacaaugugcccucauguuaucguggauguccgccaacucgagcccgugaaucugccgaugccugacguuagaaacaauuucuuucacuauaaccagggcagcgauucccggcuucgccugauugccaugcucuacacaccccugagagccaacaauucuggggacgauguguucaccgucagcugucgggugcuuacccgcccuucccccgacuuuagcuucaacuuucuggugcccccuacagucgaaucuaagaccaaaccguucacgcuccccauccugaccauuuccgagaugagcaauucuagauuuccuguucccaucgauucccugcauacaagcccuaccgaaaacaucguggugcagugccagaauggacgggucacacucgacggcgagcugauggggaccacgcaacuucugcccucucagauuugugcuuuccgcggagugcucacaagauccaccagccgggcguccgaucaggccgacacaccgaccccucgccuguucaacuauuacuggcacauccagcuugacaaucugaacggcacccccuaugauccugcugaggacauucccggcccucucgggacacccgauuuuagaggaaagguuuucggcguggccucucaacggaauccggacagcacgacccgcgcccaugaagcuaaagucgauacaaccgccgggagauuuacaccuaagcugggaucccuggagaucagcaccgaaucuggcgacuucgaucagaaccagcccacgcgguuuacacccguggggauuggaguugaccacgaggcggauuuccaacaguggucccucccugacuacagcggccaguuuacccacaauaugaaccuggcuccggccguggcccccaauuucccuggcgaacagcuucuguuuuucagaucucaacuccccagcuccgggggacgcucuaacggcauccuggauugccuugucccucaggagugggugcagcauuuuuaccaggagagcgcucccgcccaaacccaggucgcucuggugcgguauguuaauccugacacagggagaguccucuucgaagccaagcugcacaaacugggauuuaugaccaucgcgaagaacggcgacucccccauuacagugccgccuaacggguacuuccgcuucgagagcugggugaaucccuuuuauacgcucgccccuaugggcaccggaaacggccggagacgcauccaguga

SEQ ID NO: 28875 - RNA, 1647 nt, Artificial Sequence
  derived and/or modified sequence opt5 from VP1__Norovirus_and/or_Norovirus-like__AF414413
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaucgauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggauggagucuucaccgugucuugucgggugcugacacgcccuagccccgacuuuuccuucaauuuucuuguucccccuaccgucgagagcaagacaagacuguucacccucccgauccugacgauuucugaaauguccaacagccgguuucccgugccuaucgauucucugcauaccucccccacagagaauaucgugguccagugccagaacggccgcgugacccucgacggggagcugaugggaacaacccaacuucugccuagccagauuugugcguucagaggcacgcucacacggucuaccucccgcgccagcgaucaggcugacacacccaucccgagacuguucaaucaccgguggcauauucagcuugauaaccugaauggcaccccuuaugaccccgccgaagacaucccugcuccccucgggaccccugauuuucgcggaaaaguuuucggcguggccucccaaagaaaccccgacucuacaacgcgggcccacgaggcgaaggucgaugcuaccccggggagauuuacaccuaaacugggaagccuggaaauuaucaccgaguccgacgauuucgacacaaaucagagcaccaaguuuacgcccgugggcaucgggguugauaacgaagccgaguuccagcaauggucucuccccaauuacuccggacaguuuacacacaacaugaaucuggccccugcuguggccccgaacuuccccggcgagcagcuucuguuuuuccgcagccagcucccuucuagcggcgggcgguccaacggaguccuggacugccuugugccccaagaauggguccagcauuuuuaucaggagucugcuccugcccagacccaaguggcgcugguuagauacgugaaucccgauaccggccgcguccucuucgaagccaagcugcacaaacugggguuuaugacaauugcuaagaacggagacagcccuaucaccgugcccccgaauggcuacuuccgguucgaguccuggguuaacccuuuuuauacacucgcccccauggggacgggcaauggaagacgccggauucaguga

SEQ ID NO: 28876 - RNA, 1647 nt, Artificial Sequence
  derived and/or modified sequence opt5 from VP1__Norovirus_and/or_Norovirus-like__AF427112
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagccaauaacuccggggacgaugucuucaccgugucuugucgggugcugacccgcccuagccccgacuuuuccuucaauuuucuuguucccccuacagucgaaagcaagaccaaaccguucacgcugcccauccucaccauuucugagauguccaacagcagauuuccugugcccaucgauucucugcauacacggccuaccgaaaauaucgugguccagugccagaacggacgcgugacacuggacggcgagcucauggggaccacgcaacugcuucccucccagauuugugcuuucagaggaguucugacacggagcaccucucgcgcguccgaucaggccgacacagcuaccccgagacucuucaauuauuacuggcacauccagcuggacaaccuuaauggcaccccuugcgaucccgccgaggacauuccuggcccccuggggacaccugauuuucggggaaagguguucggcgucgccagccaacgcaaccccgacuccacgaccggggcucaugaagccaaaguggauacaaccgcgggaagauuuacaccgaagcucggcucucuggagaucagcaccgaauccggggacuucgaucagaaucagccuacgaaguuuacacccguuggaauuggcguggaccacgaggcugauuuccaacaguggagccugcccgacuauucuggccaguuuacccacaacaugaaucucgccccugccgucgcuccgaacuuccccggggaacagcugcuguuuuuccggucccaacuuccuagcucuggaggcagaagcaaugggauccucgauugucuggugccccaggaguggguccagcauuuuuaccaggaguccgccccugcucaaacccagguggcccuuguucgcuacgugaaccccgacacaggacggguccuguucgaagcgaaacuccacaagcugggcuuuaugaccaucgccaaaaacggggacucuccuauuacagugcccccgaauggcuauuucagauucgagagcuggguuaacccuuuuuacacgcuggcucccaugggaaccggcaaugggcgccggagaauccaguga

SEQ ID NO: 28877 - RNA, 1647 nt, Artificial Sequence
  derived and/or modified sequence opt5 from VP1__Norovirus_and/or_Norovirus-like__AF190817
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaaucccccuggcgaagugcuucugaaccucgagcuggggccggaaauuaaucccuaccuugcccaccuggcucggauguauaacggauacgccggcggcuucgagguccaggugguucucgcugggaaugccuuuaccgcgggaaaaaucaucuucgccgcuauuccucccaacuuuccuaucgacaaucugagcgccgcucagauuacaaugugcccccaugugaucgucgaugugcgccaacuggagccgguuaaccucccuaugcccgacgugagaaauaacuucuuucacuauaaccagggcuccgauucucggcugcgccuuauugccaugcuguacaccccucucagagccaauaacagcggggacgaugucuucacaguguccugucgggugcugacccgccccucucccgacuuuagcuucaauuuucuugucccuccgacaguugaauccaagaccaaacccuucacgcugccuauccucaccauuagcgagaugucuaacuccagauuucccgugccuaucgaaagccugcauacaggacccaccgagaauaucgugguccagugccagaacggccgggugacacuggauggggagcucaugggaaccacgcaacugcuuccgucucagauuugugcuuuccgcggcguucugacaagauccaccagccgggcgucugaccaggccgauacagcuaccccucgccucuucaauuauuacuggcacgugcagcuggacaaccuuaauggcacccccuaugacccugccgaagauauccccgggccucugggaacacccgacuuuagaggcaaggucuucgggguggccucccaacggaacccggauagcacgacccgcgcucaugaggccaaaguugacacaaccgcgggaagauuuacaccuaagcucggcucccuggaaauuucuaccgauagcuccgacuucgaucagaaucagcccacgcgguuuacacccguggggaucggagucgacaacgaggcugauuuccaacaguggagccugccugacuacucuggccaguuuacccacaauaugaaccucgccccggccguggcucccaauuucccuggcgaacagcugcuguuuuucagaucccaacuucccagcucugggggacgcagcaacggcguccucgauugccuggugccucaggagugggcccagcacuuuuaccaggaguccgcucccgcccaaacccagguugcgcuugugcgguaugucaacccugacacagggagagugcuguucgaagccaagcuccauaaacugggauuuaugaccauugcuaagaauggcgacucucccaucacaguuccgccuaacggguacuuccgcuucgagagcugggugaaucccuuuuauacgcuggccccuaugggcaccggaaacggccggagacgcauccaguga

SEQ ID NO: 28878 - RNA, 1647 nt, Artificial Sequence
  derived and/or modified sequence opt5 from VP1__Norovirus_and/or_Norovirus-like__LC035072
augaagauggccagcaacgacgcuacccccuccaaugauggcgccgcggggcuggugccugagaucaacaaugaagcuauggcccucgacccggucgccggagcugccauugcugcgccccugacaggccagcaaaacguuaucgauccuuggauuaugaauaacuucgugcaggcccccgggggagaguuuacggugucuccuagaaauagccccggcgaaguccuucugaaccucgagcuggggccugaaaucaauccguaccuugcccaccuggcucggauguauaacggauacgccggcggcuucgaggugcagguugugcucgcugggaaugccuuuaccgcgggaaaaauuaucuucgccgcuauucccccuaacuuucccaucgacaaucuguccgccgcucagaucacaaugugcccucaugucauuguggauguucgccaacuggagcccgugaaccucccgaugccugacgucagaaauaacuucuuucacuauaaccagggcucugauagccggcugcgccuuaucgccaugcuguacacaccccucagagccaauaacuccggggacgauguguucaccgugucuugucggguccugacccgcccuagccccgaauuuuccuucaauuuucuuguucccccuacaguggagagcaagaccaaaccguucacgcugcccauucucaccaucucugaaauguccaacagcagauuuccugugcccauugacucucugcauacauccccuaccgagaauaucgucgugcagugccagaacggacggguuacacuggauggcgagcucauggggaccacgcaacugcuucccagccagaucugugcuuuccgcggagugcugacaagaucuaccucccgggcgagcgaccaggccgauacagcuaccccgcgccucuucaauuauuacuggcacauucagcuggacaacccuaauggcacccccuaugacccugccgaagauauccccggcccucuugggacacccgacuuuagaggaaaggucuucggcguggccucccaacggaacccggauucuacgacccgcgcucaugaggccaaaguugacacaaccagcgggagauuuacaccuaagcugggaucccucgaaauuagcaccgagucugaugacuucgaucagaaucagcccacgcgguuuacacccgugggcaucggggucgacagagaagcggauuuccaacaguggucccugccugacuacagcggacaguuuacccacaacaugaaucuggcuccggccguggccgcuaacucucccggcgagcagcucauuuucuuuuggagccaauccccuuacugcggcgggcgcucuaaucggguccuggauuguauggugccccaggaguggguucagcacuucuaucaggaaagcgccccugcucaaacccagcuugcccuggugagauacgucaaccccgacacaggacgcgugcucuuugaggcgaagcugcauaaacuuggcuucaugaccaucgccaagaacggggacuccccuaucacaguucccccgaauggauauuuucgguucgaaagcugggugaacccuuucuacacgcuggcucccaugggcaccgggaauggcagacgccggguccaguga

SEQ ID NO: 28879 - RNA, 1647 nt, Artificial Sequence
  derived and/or modified sequence opt5 from VP1__Norovirus_and/or_Norovirus-like__DQ093064
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaagaucauuuuugcugccguucccccucauuuccccguggauaacaucuccgcggcccagaucacgaugugcccucacgucauuguggacgugagacagcuggaacccguccugcucccgcugccugauauccggaaucgcuuuuuccauuauaaccaggagaauacccccagaaugcggcuuguugcuaugcuguacacaccucuccgcgccaacucuggggaagacguguuuaccgugagcuguagaguccugacacggcccgcucccgauuucgaguuuaccuuccuugugccuccgacaguugaguccaagaccaaacccuuuacgcugccuauucucacccugggagaacugagcaacucucgcuuccccgccgccaucgacaugcucuaugcugauccuaaugaguccauugugguccaaccccagaacggcagaugcacacuggacgggacccuucagggaacaacccagcuggugccgacgcaaaucugugcguuucggggcacacucauuagccagaccgcccgcgcuacagauucuaccgacuccccucagagagcccgggaucacccccugcauguucaagugaagaaucuugacgggacccaguacgacccuacagaugacauccccgccguccugggagcuaucgauuucaaaggcacgguguucggcgucgccagccagcgcgacgugucugggccucaggaacaaggacacuaugcgaccagagcucacgaggcccauauugauacaaccgaccccaaguacgccccgaagcucggcacaauccugauuaaauccgaaagcaacgauuuuaucaccaaucagccuauucgguucacgcccguugggaugggagacaacaauuggagacagugggagcugcccgauuacuccggccgccucacacugaacaugaaucuugcuccugccgugucuccgagcuuucccggggagcggauccuguucuuuagauccaucgucccuagcgcuggaggcuauggcucuggguacauugacugccucaucccccaggaauggggacaacacuucuaucaggaggccgcgccuucccagagcgccguggcucugguucgcuacgugaaccccgauaccggccggaauauuuuugaagccaaacuucauagagagggguuccugaccgucgcuaacucuggaaauaacccuaucguggugcccccgaauggcuauuuucgcuucgaagccuggguuaaccaguuuuacacacucgcgccuauggggagcggccaaggacggagacgcuga

SEQ ID NO: 28880 - RNA, 1647 nt, Artificial Sequence
  derived and/or modified sequence opt5 from VP1__Norovirus_and/or_Norovirus-like__L23830
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccgcuaaagugaucuucgccgcuauucccccuaacuuucccaucgacaaucuguccgccgcccagaucaccaugugcccucaugucauuguggauguucgccaacuggagcccaucaaccucccgaugccugacgugagaaauaacuucuuucacuauaaccagggaucugauagccggcugcgccuuauugcuaugcuguacacaccccucagagcgaauaacuccggcgacgaugucuucaccgugucuugucgggugcugacacgcccuagccccgacuuuuccuucaauuuucuuguccccagcaccauggaaucuaagacaaaaccuuucacccugccgauccucacgauuuccgagaugagcaacucuagauuucccguuccuaucgauucccugcauaccagccccacagaaucuaucguggugcagugccagaaugggcgggucacccuggacggagagcucaugggcacaacccaacugcuuccuaaccagauuugugccuuccgcgggacgcugacaagauccaccaaucgggcuagcgaucaggccgacacagccacaccccgccucuucaaccaccauuggcacauccagcuggacaaucuuaacggaaccccguaugauccugcugaggacauucccgccccucugggcacccccgauuuuagaggcaagguguucgggguugcgggacaacggaauccugacuccacgacccgcgcucacgaagccaaaguggauacaaccucuggcagauuuacacccaagcucgggagccuggagaucaccacggaauccgacgauuucgacccgaaccagagcacaaaguuuaccccugucggaauuggcguggauaaugaggccgacuuccagcaauggucucugcccgauuacuccgggcaguuuacccauaacaugaaucucgcucccgccguugcuccuaacuucccgggagaacagcugcuguuuuuccggagccagcuucccucuagcggcggcagauccaacgggauccucgacugccuggugccucaagaguggguccagcacuuuuaucaggagucugcccccgcgcagacacaaguggcccuuguccgcuacgugaauccugacaccggacggguucuguucgaagcuaaacuccauaagcugggcuuuaugacaaucgccaaaaacggggauagccccauuacggugccucccaauggauacuucagauucgaguccugggucaacccguuuuauacccuggcuccuaugggcacagggaauggccgccggagaauccaguga

SEQ ID NO: 28881 - RNA, 1647 nt, Artificial Sequence
  derived and/or modified sequence opt5 from VP1__Norovirus_and/or_Norovirus-like__KX907728
augaagauggccagcaacgacgcucccccuuccucugauggcgccgggaaucuggugccggagagccaccaggaaguccucccccuggcgccuguugcuggagccgagcuugccgcucccguggugggccaaaccaacaucauugacccuuggaucaaagaaaauuucguccaggcgccccagggggaguuuacaguguccccuaagaacgcuccgggagaaauucugguuaaucucgagcugggccccaaccuuaauccuuaccuggagcaucucucuagaauguauaacgccuacgccgggggaaucgaaguggagauuauccuggccggcaaugcuuucacggccggcaaaauccugauugcugccgugcccccuaacuuucccgucgaaagcguuuccgcgucucaggccacccaauucccgcacgcuaucguggauguccggacacucgagccugugcgccugccccuuccugacgugagaagcaacuuuuuccauuauaccacaaaggaugagcccaaaaugcggcuggucauuuggcucuacacaccccugcgcaccaauggguccggagacgauagcuuuaccguuucuggcagacuucugacgcggccuuccauggacuuccaguuuagcuuccucgugccgcccaccguggaaacaaagaccguccuguuuacagugccugggcugacgccccaggagaugucuaauucccgcuggccugcccagaucagcggaaugguugugagaggcaacgaaccccaagucgugcaguuccagaaugggcggugccacaccgauggaacacuccugggcaccacaaccguuucugagcaguguauugcuggcuuuguggggaccuccacaaacacgcgcagcgccaccggauccacaaccgaaacaagaaccggcgacacggaucuuuggcugcggcucgaggagccgaacgggcaaccuuaugacaucuucggagaucagcccgccccucugggcacacccgacuuccgcgcugucauugugggguuugcgucuagaccucagacccaaggaagcuacaugaaugaagccuaugucaacaccguggacucccauuucgcucccgccacaggcaauaccaagaucauccuucggcgcggcgggacaggacacguuggcgggggacaccuguggaaauuuagaccguucggcguggaagggggcgagggacgggucagcuaccaggaguacgugcucccuaacuauucuggcgccacggcuuccaaucauaaccuggccccucccguugcgcccagaaugccgggggaacugcuccugcuuuuugagagcgauaugcccgugugggacgauggacacggcgcugccccugcccagaagauucauugccugcucccccagcaauucaucacccacuuuuucgacucucaggcuccugcccuggcugaggccgcgcuucugcgcuacguccaccccgauagcucccgggugcucuuugaaacaaaacuguauagagagggguucauggugguuucugccccuaccggacgcuuugacuucccccuggauggcuacuuucgguucgacagcugggucaauuccuucuaugugcucagcccgguggggucuggccagggaagacgcuga

SEQ ID NO: 28882 - RNA, 1644 nt, Artificial Sequence
  derived and/or modified sequence opt5 from VP1__Norovirus_and/or_Norovirus-like__AB039779
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaagauacccccagaaugcggcuuguugcuaugcuguacacaccucuccgcgccaauucuggggaggacguguuuaccgugagcuguagaguccugacacggcccgcucccgauuucgaguuuaccuuccuugugccuccgacaguugaauccaagaccaaacccuuuacgcugccuauucucacccugggagagcugagcaacucucgcuuccccgccccuaucgacaugcucuauacagaucccaacgaaaccauugugguccaaccgcagaauggcagaugcacacuggacgggacccuucagggaacgacacagcuggugccuacccaaaucuguuccuuucggggcacacucauuagccagacaccccgcucugccgauuccaccgacagcgcuccuagaguucggaaccacccccugcaugugcagcuuaagaaucuggaugggaccccuuacgaccccacggacgaggucccggcggugcucggagccaucgauuucaaaggcaccgucuucggcguggcuucucaacgcaacacaaccggguccagcguuggagccacaagagcccacgaagugcacaucgacaccacgaauccucgguauacacccaagcugggcuccguccugauguacucugagagcuccgauuuugacgaugggcagcccaccagauucaccccuauuggaaugggcgcugacgauuggcaucagugggagcucccggaauacagcgggcaccugacacuuaacaugaaucuggcccccgcgguggcuccugccuuucccggagagcgcauccucuucuuucggucuguugugccuuccgccggcggcuaugggagcggacagauugacugccugaucccccaagaauggguccagcauuucuaccaggaggcugccccuucucagagcgcuguggcccuuauuagauaugugaaccccgauaccggccgcaauaucuuugaagcgaagcugcaccgggagggguucaucacaguugccaacuccggaaauaacccgauugucgugccucccaauggcuacuuuagauucgaggcuugggugaaccaauuuuaugcccucacgccuauggggaccggccagggacgccggagaguccaguga

SEQ ID NO: 28883 - RNA, 1644 nt, Artificial Sequence
  derived and/or modified sequence opt5 from VP1__Norovirus_and/or_Norovirus-like__AB039778
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaagauacccccagaaugcggcuuguugcuaugcuguacacaccucuccgcgccaauucuggggaggacguguuuaccgugagcuguagaguccugacacggcccgcucccgauuucgaguuuaccuuccuugugccuccgacaguugaauccaagaccaaacccuuuacgcugccuauucucacccugggagagcugagcaacucucgcuuccccgccccuaucgacaugcucuauacagaucccaacgaaaccauugugguccaaccgcagaauggcagaugcacacuggacgggacccuucagggaacgacacagcuggugccuacccaaaucuguuccuuucggggcacacucauuagccagaccucucgcuccgccgauagcaccgacucugcucccagaguucggaaccacccucugcaugugcagcuuaagaaucuggaugggacacccuacgacccuacggacgagguccccgcggugcucggagccaucgauuucaaaggcaccgucuucggcguggcuucccaacgcaacacaaccgggagcuccguuggagccacaagagcccacgaagugcacaucgacaccacgaauccgcgguauacaccuaagcugggcucuguccugauguacagcgaguccagcgauuuugacgaugggcagcccaccagauucacccccauuggaaugggcgcugacgauuggcaucagugggagcucccugaauacucugggcaccugacacuuaacaugaaucuggccccggcgguggcucccgccuuuccuggagagcgcauccucuucuuucgguccguugugcccagcgccggcggcuaugggucuggacagauugacugccugaucccucaagaauggguccagcauuucuaccaggaggcugcccccagccaguccgcuguggcccuuauuagauaugugaacccugauaccggccgcaauaucuuugaagcgaagcugcaccgggagggguucaucacaguugccaacucuggaaauaaccccauugucgugccgccuaauggcuacuuuagauucgaggcuugggugaaccaauuuuauacgcucacccccauggggacaggccagggacgccggagaguccaguga

SEQ ID NO: 28884 - RNA, 1644 nt, Artificial Sequence
  derived and/or modified sequence opt5 from VP1__Norovirus_and/or_Norovirus-like__KY424345
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccccuaucgauaugcucuauacagaccccaaugaaggcauugugguccaaccgcagaacgggagaugcacccuggauggaacacuucagggcaccacgcagcuggugccuacacaaaucugugccuuucgggggacccucauuggacagacaucccgcagcucugacuccaccgauagcgcucccagacggcgcgaccacccucugcauguucagcuuaagaaucuggauggcacccaauacgaccccacagacgaggugccugcgguccucggcgccaucgauuucaaaggggcuguguucggagucgccucucagagagacguguccggcacgcagguuggggccacccgggcucacgaagugcacaucaacacaaccgaucccagauauacaccgaagcugggaagcauucugaugcauuccgagucugacgauuuugucaccggccagccuauccaauucacgcccguggggaugggagacaaugauuggcaccagugggagcuccccgacuacagcggccaucugacacuuaacaugaaucuggccccugcgguugcuccggccuuucccggcgaacgcauucucuucuuucgguccaucgugccuagcgccgggggauacggcucugggcagauugauugccugaucccccaggaguggguccaacacuucuaucaggaagcugccccuucccagagcgcuguggcccuuaucagauacgugaaccccgacaccggacgcaauauuuuugaggcgaagcugcaccgggaaggcuucaucaccguugccaacucugggaauaacccuauugucgugcccccgaauggcuauuuuagauucgaggcuugggugaaccaguuuuacacacucaccccuaugggaacaggccaagggcgccggagaaaucaguga

SEQ ID NO: 28885 - RNA, 1644 nt, Artificial Sequence
  derived and/or modified sequence opt5 from VP1__Norovirus_and/or_Norovirus-like__HQ169542
augaugauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaagaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaagauacccccagaaugcggcuuguugcuaugcuguacacaccucuccgcgccaauucuggggaggacguguuuaccgugagcuguagaguccugacacggcccgcucccgauuucgaguuuaccuuccuugugccuccgacaguugaauccaaaaccaagcccuuuacgcugccuauucucacccugggagagcugagcaacucucgcuuccccgccccuaucgacaugcucuauacagaucccaacgaaaccauugugguccaaccgcagaauggcagaugcacacuggacgggacccuucagggaacgacacagcuggugccuacccaaaucuguuccuuucggggcacacucguuagccagaccucucgcuccgccgauagcaccgacucugcucccagagugcggaaccacccucugcauguccagcuuaaaaaucuggaugggacacccuacgacccuacggacgaggugcccgcgguccucggagccauugauuucaagggcaccguguucggcguugcuucccaacgcaacacaaccgggggaagcgugggcgccacaagagcccacgaaguccacaucgacaccacgaauccgcgguauacaccuaaacugggguccgugcugauguacucugagagcuccgauuuugacgauggacagcccaccagauucacccccaucggcaugggggcugacgauuggcgccagugggagcucccugaauacagcggacaucugacacuuaacaugaaucuggccccggcgguugcucccgccuuuccuggcgagcggauucucuucuuuagaucugugguccccuccgccggcggguauggaagcggccagaucgacugccugauuccucaagaaugggugcagcacuucuaccaggaggcugcccccucucagagcgcuguggcccuuauccgcuauguuaacccugauaccgggcggaauauuuuugaagcgaagcugcauagagagggauucaucacagucgccaacuccggcaauaaccccaucguggugccgccuaauggguacuuucgcuucgaggcuugggucaaccaauuuuauacgcucacccccaugggcacaggacagggccggagacgcgugcaguga

SEQ ID NO: 28886 - RNA, 1644 nt, Artificial Sequence
  derived and/or modified sequence opt5 from VP1__Norovirus_and/or_Norovirus-like__KX228762
augaagauggccagcaacgacgcugcccccuccaaugauggcgcggcuaaccuggugccugaggccaccaaugaagucauggcccucgagccgguugugggggcuucuaucgccgcucccguggucggacagcaaaacauuaucgacccuuggauuagagaaaauuucgugcaggcgccccagggcgaguuuacaguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacggccggcaaaaucauuuuugcugccguucccccucauuuccccguggaaaauaucuccgcggcccagaucaccaugugcccucacgucauuguggaugugagacagcuggagcccguccugcucccgcugccugacauccggaaccgcuuuuuccauuauaaucaggaaaacacacccagaaugcggcuuguugcuaugcuguacaccccucuccgcgccaauucuggggaggauguguuuacagugagcuguagaguccugacccggcccgcucccgacuucgaguuuacauuccuugugccuccgaccguugaauccaagacgaaacccuuuacccugccuauucucacacugggagagcugagcaacucucgcuuccccgccccuaucgauaugcucuauaccgaccccaacgaagccauugugguccaaccgcagaauggcagaugcacacuggaugggacccuucagggaacgacacagcuggugccuacccaaaucuguuccuuucggggcacacucauuagccagaccucucgcuccgcugacagcaccgauucugcgcccagaguucggaaccacccucugcaugugcagcuuaagaaucuggacgggacacccuacgauccuacggacgagguccccgccgugcucggagcuaucgacuucaaaggcaccgucuucggcguggccucccaacgcaacacaaccgggaauagcaucggagccacaagagcucacgaaguucacauugauaccacgaacccgcgguauacaccuaagcugggcuccgugcugaugcauucugagagcaaugacuuugaugacgggcagcccaccagauucacccccaucggaaugggcgccgaugacuggcaccagugggagcucccugaauacuccgggcaucugacacuuaacaugaaucuggcgccggcugucgcccccgccuuuccuggagagcgcauucucuucuuucggagcgugguucccucugcuggcggcuacggguccggacacaucgauugccugauuccucaggaaugggugcaacacuucuaucaggaggccgcucccagccagucugccgucgcgcuuaucagauacgugaacccugacaccggccgcaauaucuuugaagccaagcugcaucgggagggguucauuacaguggcuaacagcggaaauaaccccaucguugucccgccuaauggcuauuuuagauucgaggccugggugaaccaguuuuacacgcucacccccauggggacaggccaaggacgccggagagugcaguga

SEQ ID NO: 28887 - RNA, 1644 nt, Artificial Sequence
  derived and/or modified sequence opt5 from VP1__Norovirus_and/or_Norovirus-like__AF414410
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaauccugcuuaaccuggagcucggaccugagcugaauccguaccuuucucaccugagccggauguauaacggcuacgccgggggaaugcaagugcaggucgugcucgccggcaaugcuuucacagccggcaagauuaucuuugcugccguucccccucauuuccccguggaaaacaucuccgcggcccagauuacgaugugcccucacgucaucguggaugugagacagcuggagcccgucuuucugccgcucccugacauucggaaucgcuucuuucauuauaaccaggaaaauacccccagaaugcggcugguugcuaugcuuuacacaccucugcgcgccaacucuggggaggauguguucaccgugagcuguagaguccucacacggcccgcucccgacuuugaguucaccuuucuggugccuccgacaguugaauccaagaccaaacccuucacgcuuccuauccugacccucggagagcugagcaacucucgcuuucccgccccuauugauaugcuguauacagaccccaaugaaaccaucgugguccaaccgcagaacggcagaugcacacucgaugggacccugcagggaacgacacagcuugugccuacccaaauuuguuccuuccggggcacacugaucagccagaccucucgcuccgccgacagcaccgauucugcucccagagcgcggaaucacccucuccauguucagcugaagaaccuugacgggacacccuacgauccuacggacgaggugcccgccguccugggagcuaucgacuucaaaggcaccguguuuggcgucgccucccaacgcaauacaaccgggagcuccgugggagccacaagagcucacgaaguucacauugauaccacggacccgcgguauacaccuaagcucggcucugugcugauguacagcgaguccaacgauuucgacgaugggcagcccaccagauuuacccccaucggaaugggcgccgacgauuggcaucagugggagcugccugaauacagcgggcaccucacacugaauaugaaccuugcgccggcugucgcccccgccuucccuggagagcgcauucuguuuuuccggucugugguucccuccgcuggcggcuaugggagcggacagaucgacugccucauuccucaagaaugggugcagcauuuuuaccaggaggccgcucccucucagagcgccgucgcgcugaucagauaugugaauccugauaccggccgcaacaucuucgaagccaaacuucaccgggagggguuuauuacaguggcuaauuccggaaacaaucccaucguugucccgccuaacggcuacuucagauuugaggccugggugaaucaauucuauacgcugacccccauggggacaggccagggacgccggagagugcaguga

SEQ ID NO: 28888 - RNA, 1644 nt, Artificial Sequence
  derived and/or modified sequence opt5 from VP1__Norovirus_and/or_Norovirus-like__KU935739
augaagauggccagcaacgacgcugcccccuccaaugauggcgcggcuaaccuggugccugaggccaccaaugaagucauggcccucgagccgguugugggggcuucuaucgccgcucccguggucggacagcaaaacauuaucgacccuuggauuagagaaaauuucgugcaggcgccccagggcgaguuuacaguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacggccggcaaaaucauuuuugcugccguucccccucauuuccccguggaaaauaucuccgcggcccagaucaccaugugcccucacgucauuguggaugugagacagcuggagcccguccugcucccgcugccugacauccggaaccgcuuuuuccauuauaaucaggaaaacacacccagaaugcggcuuguugcuaugcuguacaccccucuccgcgccaauucuggggaggauguguuuacagugagcuguagaguccugacccggcccgcucccgacuucgaguuuacauuccuugugccuccgaccguugaauccaagacgaaacccuuuacccugccuauucucacacugggagagcugagcaacucucgcuuccccgccccuaucgauaugcucuauaccgaccccaacgaagccauugugguccaaccgcagaauggcagaugcacacuggaugggacccuucagggaacgacacagcuggugccuacccaaaucuguuccuuucggggcacacucauuagccagaccucucgcuccgcugacagcaccgauucugcgcccagagcccggaaccacccucugcauguucagcuuaagaaucuggacgggacacccuacgauccuacggacgaggugcccgcuguccucggagccaucgacuucaaaggcaccguguucggcgucgccucccaacgcaacacaaccgggaauagcaucggagcuacaagagcccacgaagugcacauugauaccacgaacccgcgguauacaccuaagcugggcuccguucugauguacucugagagcaaugacuuugaugacgggcagcccaccagauucacccccaucggaaugggcgcggaugacuggcaucagugggagcucccugaauacuccgggcaccugacacuuaacaugaaucuggcuccggccguggcccccgcuuuuccuggagagcgcauucucuucuuucggagcgucgugcccucugccggcggcuauggguccggacauaucgauugccugauuccucaggaauggguucaacacuucuaccaggaggcugcccccagccagucugcgguggcccuuaucagauaugucaacccugacaccggccgcaauaucuuugaagcuaagcugcaccgggagggguucauuacaguggccaacagcggaaauaaccccaucgugguuccgccuaauggcuacuuuagauucgaggcuugggucaaccaguuuuauacgcucacccccauggggacaggccaaggacgccggagagugcaguga

SEQ ID NO: 28889 - RNA, 1644 nt, Artificial Sequence
  derived and/or modified sequence opt5 from VP1__Norovirus_and/or_Norovirus-like__KX268709
augaagauggccagcaacgacgcugcccccuccaaugauggcgcggcuaaccuggugccugaggccaccaaugaagucauggcccucgagccgguugugggggcuucuaucgccgcucccguggucggacagcaaaacauuaucgacccuuggauuagagaaaauuucgugcaggcgccccagggcgaguuuacaguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacggccggcaaaaucauuuuugcugccguucccccucauuuccccguggaaaauaucuccgcggcccagaucaccaugugcccucacgucauuguggaugugagacagcuggagcccguccugcucccgcugccugacauccggaaccgcuuuuuccauuauaaucaggaaaacacacccagaaugcggcuuguugcuaugcuguacaccccucuccgcgccaauucuggggaggauguguuuacagugagcuguagaguccugacccggcccgcucccgacuucgaguuuacauuccuugugccuccgaccguugaauccaagacgaaacccuuuacccugccuauucucacacugggagagcugagcaacucucgcuuccccgccccuaucgauaugcucuauaccgaccccaacgaagccauugugguccaaccgcagaauggcagaugcacacuggaugggacccuucagggaacgacacagcuggugccuacccaaaucuguuccuuucggggcacacucauuagccagaccucucgcuccgcugacagcaccgauucugcgcccagagcccggaaccacccucugcauguucagcuuaagaaucuggacgggacacccuacgauccuacggacgaggugcccgcuguccucggagccaucgacuucaaaggcaccguguucggcgucgccucccaacgcaacacaaccgggaauagcaucggagcuacaagagcccacgaagugcacauugauaccacgaacccgcgguauacaccuaagcugggcuccguucugaugcauucugagagcaccgacuuugaugacgggcagcccaccagauucacacccaucggaaugggcgcggaugacuggcaccagugggagcucccugaauacuccgggcaucugacccuuaauaugaaccuggcuccggccguggcccccgcuuuuccuggagagcgcauucucuucuuucggagcgucgugcccucugccggcggcuacggguccggacacaucgauugccugauuccucaggaauggguucaacacuucuaucaggaggcugcccccagccagucugcgguggcccuuaucagauacgucaauccugacacaggccgcaacaucuuugaagcuaagcugcaucgggagggguucauuacgguggccaauagcggaaacaaucccaucgugguuccgccuaacggcuauuuuagauucgaggcuugggucaaucaguuuuacacccucacacccauggggaccggccaaggacgccggagagugcaguga

SEQ ID NO: 28890 - RNA, 1644 nt, Artificial Sequence
  derived and/or modified sequence opt5 from VP1__Norovirus_and/or_Norovirus-like__KX158282
augaagauggccagcaacgacgcugcccccuccaaugauggcgcggcuaaccuggugccugaggccaccaaugaagucauggcccucgagccgguugugggggcuucuaucgccgcucccguggucggacagcaaaacauuaucgacccuuggauuagagaaaauuucgugcaggcgccccagggcgaguuuacaguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacggccggcaaaaucauuuuugcugccguucccccucauuuccccguggaaaauaucuccgcggcccagaucaccaugugcccucacgucauuguggaugugagacagcuggagcccguccugcucccgcugccugacauccggaaccgcuuuuuccauuauaaucaggaaaacacacccagaaugcggcuuguugcuaugcuguacaccccucuccgcgccaauucuggggaggauguguuuacagugagcuguagaguccugacccggcccgcucccgacuucgaguuuacauuccuugugccuccgaccguugaauccaagacgaaacccuuuacccugccuauucucacacugggagagcugagcaacucucgcuuccccgccccuaucgauaugcucuauaccgaccccaacgaagccauugugguccaaccgcagaauggcagaugcacacuggaugggacccuucagggaacgacacagcuggugccuacccaaaucuguuccuuucggggcacacucauuagccagaccucucgcuccgcugacagcaccgauucugcgcccagaguucggaaccacccucugcaugugcagcuuaagaaucuggacgggacacccuacgauccuacggacgagguccccgccgugcucggagcuaucgacuucaaaggcaccguccugggcguggccucccaacgcaacacaaccgggagcuccaucggagccacaagagcucacgaaguucacauugauaccacgaauccgcgguauacaccuaagcugggcucugugcucaugcauagcgaguccaccgacuucgaugacgggcagcccaccagauuuacacccaucggaaugggcgccgaugacuggcaccagugggagcugccugaauacagcgggcaucuuacccugaacaugaaucucgcgccggcugucgcccccgccuucccuggagagcgcauucuguuuuuccggucugugguucccuccgcuggcggcuacgggagcggacacaucgauugccuuauuccucaggaaugggugcaacacuuuuaucaggaggccgcucccucucagagcgccgucgcgcugaucagauacgugaacccugacacaggccgcaauaucuucgaagccaagcuccaucgggagggguuuauuacgguggcuaacuccggaaauaaccccaucguugucccgccuaauggcuauuucagauuugaggccugggugaaccaguucuacacccugacacccauggggauuggccaaggacgccggagagugcaguga

SEQ ID NO: 28891 - RNA, 1644 nt, Artificial Sequence
  derived and/or modified sequence opt5 from VP1__Norovirus_and/or_Norovirus-like__AB126320
augaagauggccagcuccgacgcugcccccucuaccgauggcagcgcgagacuggugccugaggucaacaaugaaacaauggcucucgagccgguugugggggcuccccuggccgccccuguggccggacagcacaacaucauugaccccuggaucaaaaugaauuucguccaagcuccuaacggcgaauuuacggugucuccccggaaugccccuggggagauucuucuggaucucgaacugggaccggaccuuaaccccuaccugucccaucucgcgcgcauguauaauggcuacgccgggggaauggagguucaggugguccuggcuggcaacgccuucaccgcuggcaagaucauuuuugccgcggugccucccaauuucccugccgagaaccugagcgcugcccagguuacaaugugcccccacgugaucgucgaugugagacagcucgaaccggugaugcugccuaugcccgacauccggaauaaacuuuuucauuauaaccaagucgaugacccuaagcugcgccuccuggcuuaccuuuauacaccccugagagccaauaacgccggggaugacguuuucaccguguccugucgggugcucacccgccccacaccugauuuugaguucauguuucuggucccgcccaccguggaaucuaaaacgaagccuuucagccugcccucccucacccuggacgagcuuagcaauucuagauuuccugcucccauuguucagcuguacacaaacccgcacgauaaccucgugguccagccucagaauggacggugcaccaucgacggccugcuucaagggacaacccagcugguguccuguaacguuugcagcuuccgcggaacgauuggcgacgggcagcccgcgucucauuccgaggaagagaucaugccuauggccuuuaauauucagagagaaaucaugcucgagaaccuggauggaacacccuaugacccugcugaugacauucccgccgugcugggcagcccggauuuccaaggcgucaucuucgggauccucucucagcggaauaccgacggacagacacgcgcccacgaagcuaagguggauaccagagccgcgcgguuugcuccuaaacugggcuucgucguggccaccguugaguccacagacuuucacgccaaccaacccagccgcuucacgcccguggggcuuggaggcgauaauaaccaggacuuuaaucaguggagacugccugcuuacgggggagcccucaccaacaauacaaaccuggcuccgcccgucaugccuguguaccccggcgagcagcuucuguucuuucggucccaacucccuucuagcggcgggguugugggaggcuggcuggauugucugcucccccaggaauggguccagcauuucuuucaggaguccgccaccagccaaucugacguggcgcuggugagauauauuaauccuacaaccgggcgcguucuuuucgaagccaagcugcacaaacagggauuucucacggucgcugccuccggcagcuacccccugguggugccggcugacggguauuuccgguuugagucuugggucaaccaguucuacacacuggccccuaugggcaauggaagcggcagacgccgggcgagauga

SEQ ID NO: 28892 - RNA, 1644 nt, Artificial Sequence
  derived and/or modified sequence opt5 from VP1__Norovirus_and/or_Norovirus-like__AY077644
augaagauggccagcaacgacgcuucccccucugccgauggcagcgcggggcuggugccugaggucaauaacgaaaccauggcucucgagccgguugugggagcuccccuggccgccccuguggccggccagcacaauaucauugaccccuggaucaaaaugaacuucguccaagcuccuaauggggaauuuacagugucccccagaaacgccccuggagagauucuucuggaucucgaacugggcccggaccuuaaucccuaccugucucaucucgcgcggauguauaacggguacgccggaggcauggagguucaggugguccuggcuggcaaugccuucacggcugggaagaucauuuuugccgcggugccucccaacuucccugccgagaaucugagcgcugcccagguuaccaugugcccccacgugaucgucgaugugcgccagcucgaaccggugaugcugccuaugcccgacaucagaaacaaacuuuuucauuauaaucaagucgaugacccuaagcugcggcuccuggcuuaccuuuauacaccccugcgcgccaacaaugccggagaugacguuuucaccguguccuguagagugcucacacggcccaccccugauuuugaguucauguuucuggucccgcccacaguggaaucuaaaaccaagccuuucagccugcccucccucacgcuggacgagcuuagcaacucucgcuuuccugcucccauuguucagcuguacaccaacccgcacgauaaucucgugguccagccucagaacggcagaugcacaaucgacgggcugcuucaaggaaccacacagcugguguccuguaauguuugcagcuuccggggcacccucggggacggacagcccgcgucucauuccgaggaagagauuaugccuauggccuuuaacauccagcgcgaaauuaugcuggagaaucuggauggcagccccuaugacccuacggaugacauccccgcugugcucggcucuccggauuuccaaggggucguguucggcauucugucccagagaaacacagacggacagacccgggcccacgaagccaaggucgauacacgccuugcuagauuugccccuaaacugggguucgugguugcgaccguggagaauaccgacuuucacgcuaaccaacccugucgguucacacccgucggacucggcggggauaauaaccgcgacuuuaaucaguggggacugccugccuacggcggcgcccuuacgaacaauaccaaccuggcuccgcccgugaugccuguuuaccccggggagcagcuccuguucuuuagaagccagcugccuuccucuggaggcguggucgggggauggcucgauugccugcuuccccaagaaugggugcagcauuucuuucaggagagcgccacaucccagagcgacguggcucugguucgguauaucaauccuaccacaggcagaguccucuucgaagccaagcugcacaaacaaggguuucugaccguggcggccucuggcuccuacccccuuguggucccggcugacggauauuuccgcuuugagagcugggugaaccaguucuacacgcucgccccuaugggcaacgggucuggacggagacgcguucgguga

SEQ ID NO: 28893 - RNA, 1644 nt, Artificial Sequence
  derived and/or modified sequence opt5 from VP1__Norovirus_and/or_Norovirus-like__AY823306
augaagauggccagcuccgacgcugcccccucuagcgauggcuccgcggggcuggugccugaggucaacucugaaaccauggcucucgagccgguugugggagcuccccuggccgccccuguggccggccagcacaauaucauugaccccuggaucaaacuuaacuucguccaagcuccuaauggggaauuuacagugagccccagaaacgccccuggagagauucugcucgaucuggaacuuggcccggaccugaaucccuaccucgcgcaucugucccggauguauaacgccuacgcugggggaauggagguucaggugauccuggccggcaaugcuuucacggccggcaagauuaucuuugcggccgucccucccaacuucccucucgagaaucugucugcugcccagaucaccaugugcccccacauuaucguggauguucgccagcuugaaccggugaugcugccuaugcccgacgucagaaaccggcucuuucauuauaaucaagugcgcgagccuagacugcggcuuguggcuuaccuguauacaccccuccgcgccaacaaugccggggaugacgucuucaccguuagcuguagagugcugacacggcccucccaggauuuugaguucauguuucuggugccuccgagcgucgaaucuaaaaccaagcccuucucccucccuaaccugacacuugcugagcugagcaauucucgcuuuccccucccuauugaacagcuguacaccaacccccuugacaaccuggugguucagccgcaaaauggaagaugcacgaucgauggcauucuccuggggaccacacagcuggugccuucccucaucuguagcaugcggggaacccuggaggcggaccaggccucuggccacacagaugacgaauccguccagagccgcgcuuucaacagacaacggucccuuaugcuggagaaucccgacgggucugccuuugauccuagcgacgaagugcccgccguucucggagugccugauuuccgcggcgucguguucggcguccugucccagagaaacaauggggacaccacgcggagccaugaggcuaaaauugauacaagacgcccccgguaugccccgaaacuuggauuuguggagguucugaccgaaucugacgauuuccagaacggcccucccacaaaguuuacccccguggggcucggaggcgacgggaauccugauuuccaacagugggcgcugccggacuacggaggcgcucugaccaacaauacaaaccucgcucccccugucgugcccguuuacccuggcgagcagauccuguuuuucagaucccagcuucccagcucugggggaacgguggccggcuggcuggauugccuccugccucaagaauggauccagcacuuuuaucaggacagcgccgccgcucaguccgacgucgcccuggugcgcuacauuaaucccgcgaccgggcgggugcuuuucgaggccaagcuccacagacaaggauuucugacaguuucugcugccggcccgcauccugucguggcucccgccgauggguauuuccgcuuugaaagcugggugaaccaguucuacacccuggcgccuaugggcaauggauccggccggagacgcgucuga

SEQ ID NO: 28894 - RNA, 1638 nt, Artificial Sequence
  derived and/or modified sequence opt5 from VP1__Norovirus_and/or_Norovirus-like__KF586508
augaugauggccagcaaggacgcuaccuccaacauggauggcacaucuggggccggacagcuggugcccgagaauaacaauacgagcgaaccuaucaacauggagccggucgcgggcgcuguuaccgccgccgcuacagccgggcaagugaauaugauugaccccuggaucaugaacaauuacgugcaggcuccucagggagaguucaccauuucccccaacaauacaccuggcgauauccucuuugaccugcagcuugggccccaccugaacccuuuccucgcccaucugucucaaauguauaauggaugggucggcaacaugaaagugagaguugugcuugcgggcaaugccuuuagcgcugggaagauuaucgucugcuguaucccgcccggauucuccgccccuaacauuucuaucgcucaggccaccauguuuccccacgugauugcggauguucgggugcuggaaccuaucgacauuccccucgaugacguccgcaaugugcuguuccauaacaacgauaauggcaaccagacaaugagacugcucugcaugcuguacaccccgcuucggagcgggggaacguccagcggcaccgacccuuuugugaucgccgggcgcguccugacaugucccaccccugauuucaauuuucucuuccugguuccucccacaguggaacagaaaaccaagcaauuuucugugcccaaccuuccgcugaaugucauguccaacagcagagugcccucucuccugaaugcuaugguuguguccccugaccaggcccaggucgugcaguuccaaaacggacggugcacgcuggauggccagaugcucggcacaaccacaguuagcgcuucuuguguggcccgcuuuagagggaaaaccuuccaggcccccgacaaucggcugggaauuaaccuugcugagaucuccggcgagccuuaucacgcguucgaaagccccgccccgcugggguuuccugacuucggagauggcgacuggcaugucaccgcuacaaaggugacgcccucccaacucgaggccaaugauccugucgugauggggaacguucagcccuacaauccucaguuugcuccccaccugggaacccuuguggucgaaaacccgacaccugacaaugugaccacaggcaccgaucuccuguucaacaucacguggcugucuaaccgcgccaauaacagauuuaaucccuggguuauucccaacuauggcagcacacugaccgaggccgcgcagcucgcuccuuccaucuucccgcccggguuuggagagaccauuguguacuucaauagcacauuuccugccgucggcgccaccacacacgcugccauccccugccugcuuccucaagaguucguggcucauuuugugaacgaacaggcccccauucgcggggaagcggcccugcuccacuauaucgacccugauacgcaucggaaucugggagaguucaagaucuaccccgaaggcuuuguuaccugugucccgaacgucgggggcacaggaccucagucucuucccaccaauggcauuuucguguucguguccugggugagcagauacuaucagcugaaaccuguugggacagcuggacaagcccggcgccucuga

SEQ ID NO: 28895 - RNA, 1638 nt, Artificial Sequence
  derived and/or modified sequence opt5 from VP1__Norovirus_and/or_Norovirus-like__HQ637267
augaugauggccagcaaggacgcuaccuccaacauggauggcacaucuggggccggacagcuggugcccgagaauaacaauacgagcgaaccuaucaacauggagccggucgcgggcgcuguuaccgccgccgcuacagccgggcaagugaauaugauugaccccuggaucaugaacaauuacgugcaggcuccucagggagaguucaccauuucccccaacaauacaccuggcgauauccucuuugaccugcagcuugggccccaccugaacccuuuccucgcccaucugucucaaauguauaauggaugggucggcaacaugaaagugagaguugugcuugcgggcaaugccuuuagcgcugggaagauuaucgucugcuguaucccgcccggauucuccgccccuaacauuucuaucgcucaggccaccauguuuccccacgugauugcggauguucgggugcuggaaccuaucgacauuccccucgaugacguccgcaaugugcuguuccauacaaacgauaacggcaaucagaccaugagacugcucugcaugcuguacacgccgcuucggagcgggggaaccuccagcggcacagacccuuuugugaucgccgggcgcguccugaccugucccacaccugauuucaacuuucucuuccugguuccucccaccguggaacagaaaacgaagcaauuuucugugcccaaucuuccgcugaacgucauguccaauagcagagugcccucucuccugaacgcuaugguuguguccccugaccaggcccaggucgugcaguuccaaaauggacggugcacacuggauggccagaugcucggcaccacaaccguuagcgcuucuuguguggcccgcuuuagagggaaaaccuuccaggcccccgacaaccggcugggaauuaaucuugcugagaucuccggcgagccuuaucacgcguucgaaagccccgccccgcugggguuuccugacuucggagauggcgacuggcaugucacagcuacgaaggugacccccucccaacucgaggccaacgauccugucgugguugggaaugugcagcccuacaacccucaguuugcuccccaccugggaacacuugucguggaaaauccgaccccugaccagguugccacaggcaccgaucuccuguucaacaucacguggcugucuaaucgcgccaacaacagauuuaaucccugggugauucccaacuauggcagcacacugaccgaggcggcucaacucgccccuuccaucuucccgcccggguuuggagagaccauugucuacuucaauagcacauuuccugccgugggcgcuaccacacacgccgcuauccccugccugcuuccucaggaguucguggcccauuuuguuaacgaacaggcgcccauucgcggggaagccgcucugcuccacuauaucgacccugauacgcaucggaaucugggagaguucaagaucuaccccgaaggcuuugucaccugugugccgaacgucgggggcacaggaccucagucucuucccaccaauggcguguucguguucguuuccugggugagcagauacuaucaacugaaaccugucgggacagccggacaggcucggcgccucuga

SEQ ID NO: 28896 - RNA, 1629 nt, Artificial Sequence
  derived and/or modified sequence opt5 from VP1__Norovirus_and/or_Norovirus-like__AY134748
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcaggauaacgaccaccuuuauaauaucaccauuaccaaccugaauggcuccccguucgacccuagcgaagauauccccgcgccucucggggugcccgacuuccaaggacgcgucuuuggcgugauuacacagagagauaagcagaacgccgcugggcaaucucagccugccaaucggggacacgacgccgucgugcccacguacaccgcucaguacacaccgaaacugggccagguucaaaucgggaccuggcagacagaugaccugaaggugaaccagccugucaaauucacccccgugggacucaaugauacggagcacuuuaaccaguggguugugccccgcuaugccggcgcgcugaaucuuaacacaaaucuggcuccuuccgucgccccgguguuccccggcgaaagacuccuguuuuuccggagcuaccuuccucugaaagggggauauggcaaccccgccaucgacugccuccugccucaagagugggugcagcauuuuuaccaggaggcugcccccuccaugucugaaguugcucugguccgcuauauuaauccugauaccgggagagcccucuucgaggcgaagcugcaccgggccggauuuaugaccgugagcuccaacacaagcgcucccguggucgugccggccaacggcuacuucagauuugacucuuggguuaaucaguucuauucccuugcuccuauggggaccggcaacggacgccggagaauccaauga

SEQ ID NO: 28897 - RNA, 1629 nt, Artificial Sequence
  derived and/or modified sequence opt5 from VP1__Norovirus_and/or_Norovirus-like__AY054300
augaagauggccagcaacgacgcugcccccuccaccgauggcgcggcugggcuggugccugagucuaauagcgaagucauggcccucgagccgguugccggagcugcccuggcugcccccgugacaggccagacgaacaucauugacccuuggaucagagcgaauuucgugcaagcccccaacggggaauuuaccgucuccccucggaaugcucccggagaggugcuucugaaccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucccuguucccauugaucagauguuuaccuccccgaacgaggugaucagcguccagugucagaacggacggugcacgcuugacggcgaacugcaagggacaacccagcuccaggugucuggaauuugugccuucaagggcgagguuacagcucaucugcacgauaaugaccaccuuuacaacgugaccaucaccaaucugaacggcuccccuuucgaccccagcgaagauauuccugcgccccucggggucccugacuuucagggacgcguguucggcgucaucucucaaagagauaagcagaaugccgcugggcacuccgagcccgccaaccggggacaugacgccgugguuccgacauauacggcucaguacaccccuaaacugggccaaauucagaucgggacauggcagaccgaugaccuccaggugaaucaacccgucaaguuuacacccgugggacugaacgauaccgaacacuucaaucaguggguugugccucgcuacgccggcgcgcugaaccuuaauacgaaccuggcuccgagcgucgcccccguguuuccuggcgagagacuccuguucuuucgguccuaucuuccccugaaagggggauacggcaauccugccaucgacugccuccugccccaggagugggugcagcauuucuaucaagaagcugccccuucuaugagcgagguugcucugguccgcuacauuaaccccgauacagggagagcccucuuugaagcgaagcugcaccgggccggauucaugaccguguccagcaauaccucugcuccgguggucgugccugccaacggcuauuuuagauucgacuccuggguuaaccaguuuuacagccuugcucccauggggacaggcaauggacgccggagagugcaguga

SEQ ID NO: 28898 - RNA, 1629 nt, Artificial Sequence
  derived and/or modified sequence opt5 from VP1__Norovirus_and/or_Norovirus-like__KY485125
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgagaucauuagcgugcagugucagaauggacggugcacgcuugacggcgaacugcaagggacaacccagcuccaggucucuggaaucugugccuuuaagggcgaggugacagcucaucugcacgauaacgaccaccuuuauaauguuaccauuaccaaccugaauggcuccccguucgacccuagcgaagauauccccgcgccucucggggugcccgacuuccagggacgcgucuuuggcauuaucucucaaagagauaagcacaacuccccugggcauaaugagcccgccaaccggggacacgacgcuguggucccgacauacacggcccaguacaccccuaaacugggccagauccaaauugggacauggcagaccgaugaccugacagugaaucagcccguuaaguucacccccgugggacucaacgauacggaacauuuuaaucagugggucgugccucgcuaugccggcgcucugaaccuuaauacaaaccuggccccgagcguugcgcccguguucccuggcgagagacuccuguuuuuccgguccuacaucccccuuaaagggggauauggcaauccugcuauugacugccugcucccccaagaguggguccagcacuuuuaccaggaagccgccccuucuaugagcgagguggcucuggugcgcuauaucaaccccgauaccgggagagcccuguucgaagcuaagcuccaccgggccggauuuaugaccguuuccagcaacacaucugcgccggucguggugccugccaauggcuacuucagauuugacuccugggucaaccaguucuauagccuggcucccauggggaccggcaauggacgccggagagugcaauga

SEQ ID NO: 28899 - RNA, 1629 nt, Artificial Sequence
  derived and/or modified sequence opt5 from VP1__Norovirus_and/or_Norovirus-like__KY485123
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaaugggcaugccggaggcauggagguucaggugaugcuggcgggcaacgccuucacagcugggaaacuggucuuugccgcugugcccccucacuuccccguugaaaaucucuccccucagcagauuaccauguuuccccaugugaucauugaugucagaacacuggagccggugcuucugccucuccccgacgugcggaacaauuucuuucacuacaaccaaaaggaugacccuaaaaugcgcaucgucgccaugcuguauacaccccuuagaucuaauggaagcggcgaugacguuuucaccguguccugccgggugcugacccgccccucuccugauuuugacuucacguaccucgucccgcccaccguggaaagcaagacaaaaccuuuuacccugcccauccugacacucggggagcuguccaacagcagauucccuguuucuauugaucagauguauaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuacaaugugaccaucaccaaccugaauggcuccccguucgacccuagcgaagauauucccgcgccucucgggguccccgacuuccagggacgcguguuuggcaucauuucucaaagagauaagcauaacuccccugggcacaaugagcccgccaaccggggacaugacgcugucgugccgacauauacggcccaguacaccccuaaacugggccagauccaaaucgggacauggcagaccgaugaccugacaguuaaucagcccgugaaguucacccccgucggacucaacgauacggaacacuuuaaucagugggugguuccucgcuacgccggcgcucugaaccuuaauacaaaccuggccccgagcguggcgcccgucuucccuggcgagagacuccuguuuuuccgguccuauauuccccuuaaagggggauacggcaauccugcuaucgacugccugcucccccaagagugggugcagcacuuuuaucaggaagccgccccuucuaugagcgagguggcucugguucgcuacauuaaccccgauaccgggagagcccuguucgaagcuaagcuccaucgggccggauuuaugaccgucuccagcaacacaucugcgccggugguggucccugccaauggcuauuucagauuugacuccugggugaaccaguucuacagccuggcucccauggggaccggcaauggacgccggagaguucaauga

SEQ ID NO: 28900 - RNA, 1629 nt, Artificial Sequence
  derived and/or modified sequence opt5 from VP1__Norovirus_and/or_Norovirus-like__KY485126
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgagaucauuagcgugcagugucagaauggacggugcacgcuugacggcgaacugcaagggacaacccagcuccaggucucuggaaucugugccuuuaagggcgaggugacagcucaucugcacgauaacgaccaccuuuauaauguuaccauuaccaaccugaauggcuccccguucgacccuagcgaagauauccccgcgccucucggggugcccgacuuccagggacgcgucuuuggcauuaucucucaaagagauaagcacaacuccccugggcauaaugagcccgccaaccggggacacgacgcuguggucccgacauacacggcccaguacaccccuaaacugggccagauccaaauugggacauggcagaccgaugaccugacagugaaucagcccguuaaguucacccccgugggacucaacgauacggaacauuuuaaucagugggucgugccucgcuaugccggcgcucugaaccuuaauaucaaccuggccccgagcguugcgcccguguucccuggcgagagacuccuguuuuuccgguccuacauuccccuuaaagggggauauggcaauccugcuaucgacugccugcucccccaagaguggguccagcacuuuuaccaggaagccgccccuucuaugagcgagguggcucuggugcgcuauauuaaccccgauacagggagagcccuguucgaagcuaagcuccaccgggccggauuuaugaccguuuccagcaacaccucugcgccggucguggugccugccaauggcuacuucagauuugacuccugggucaaccaguucuauagccuggcucccauggggacaggcaauggacgccggagagugcaauga

SEQ ID NO: 28901 - RNA, 1629 nt, Artificial Sequence
  derived and/or modified sequence opt5 from VP1__Norovirus_and/or_Norovirus-like__U70059
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuccaagggcgagguuacagcucaucugcaggauaacgaccaccuuuauaauaucaccauuaccaaccugaauggcagcccguuugacccuucugaagauauccccgcgccucucggggugcccgacuuccaaggacgcgucuucggcgugauuacacagagagauaagcagaacgccgcugggcaaucccagccugccaaucggggacacgacgccgucgugcccacguacaccgcucaguacacaccgaaacugggccagguucaaaucgggaccuggcagacagaugaccugaaggugaaccagccugucaaauuuacccccgugggacucaaugauacggagcacuucaaccaguggguugugccccgcuaugccggcgcgcugaaucuuaacacaaaucuggcuccuagcgucgccccgguguuucccggcgaaagacuccuguucuuucgguccuaccuuccucugaaagggggauauggcaaccccgccaucgacugccuccugccucaagagugggugcagcauuucuaccaggaggcugcccccucuaugagcgaaguugcucugguccgcuauauuaauccugauaccgggagagcccucuuugaggcgaagcugcaccgggccggauucaugaccguguccagcaacacaucugcucccguggucgugccggccaacggcuacuuuagauucgacuccuggguuaaucaguuuuauagccuugcuccuauggggaccggcaacggacgccggagagugcaauga

SEQ ID NO: 28902 - RNA, 1629 nt, Artificial Sequence
  derived and/or modified sequence opt5 from VP1__Norovirus_and/or_Norovirus-like__LC145808
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacgcgccugggcauaaugagcccgccaaccgggcucacgacgccgugguuccgacauacacggcccaguacaccccuaaacugggacagauucaaaucggcacauggcagaccgaugaccugacagugaaucagcccgucaaguucacccccguggggcucaacgauacggaccauuuuaaucaguggguugugccucgcuaugcuggagcccugaaccuuaauacaaaccuggcgccgagcgucgcucccguguucccuggcgaaagacuccuguuuuuccgguccuacaucccccuuaaaggcggguauggaaccccugccauugauugccugcucccccaagagugggugcagcacuuuuaccaggaggccgcuccuucuaugagcgaaguugcccugguccgcuauaucaaucccgacaccggcagagcucuguucgaggccaagcuccaccgggcgggguuuaugacaguguccagcaacaccucugccccgguggucgugccugcuaacggauacuucagauuugauuccuggguuaaucaguucuauagccuggcccccaugggcacagggaacggccgccggcggauucaauga

SEQ ID NO: 28903 - RNA, 1629 nt, Artificial Sequence
  derived and/or modified sequence opt5 from VP1__Norovirus_and/or_Norovirus-like__LC145795
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccaucaaucagcccgugaaguucacgcccgucgggcucaacgauacagaccauuuuaaucagugggugguuccucgcuaugccggagcucugaaccuuaauaccaaccuggccccgagcguggcgcccgucuucccuggcgaaagacuccuguuuuuccgguccuacauuccccuuaaaggcggguauggaaccccugcuaucgauugccugcucccccaagagugggugcagcacuuuuaccaggaggccgccccuucuaugagcgaaguggcucugguucgcuauauuaaucccgacacaggcagagcccuguucgaggcuaagcuccaccgggccggguuuaugaccgucuccagcaacacaucugcgccggugguggucccugccaacggauacuucagauuugauuccugggugaaucaguucuauagccuggcucccaugggcacggggaacggccgccggagaauccaauga

SEQ ID NO: 28904 - RNA, 1629 nt, Artificial Sequence
  derived and/or modified sequence opt5 from VP1__Norovirus_and/or_Norovirus-like__AB629941
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgccuguauaauggguacgccggaggcauggagguucaggugaugcuggcgggcaacgccuucacagcugggaaacucgucuuucccgccgugccuccccauuucccuauugaaaaucugucuccccagcagaucaccauguuuccgcacguuauuaucgaugugagaacacuugagccuguccugcucccccugccugacgugcggaacaauuucuuucauuauaaccaaaaggaugaccccaaaaugcgcaucguggcuaugcuuuacacaccccugagauccaauggaagcggcgaugacgucuucaccguuuccugccgggugcucacccgcccuucuccggauuuugacuucacguaucuggugcccccuaccgucgaaagcaagacaaaacccuuuacccugccuauucucacacugggggagcuuuccaacagcagauuccccgugucuaucgaucagauguacaccuccccgaacgagguuauuagcgugcagugucagaauggacggugcacgcuggacggcgaacuccaagggacaacccagcugcaggucucuggaaucugugccuuuaagggcgaggugacagcccaccuucaugauaacgaccaccuguauaauauuaccaucaccaaccucaauggcuccccuuucgaccccagcgaagauauuccugcuccccuggggguuccugacuuccagggacgcguguuuggcaucaucucucaaagagauaagcacaacucccccgggcauaaugagccggcgaaccggggacacgacgccgucgugccuacauacacggcucaguacacccccaaacugggccagauucaaaucgggacauggcagaccgaugaccucacagucagccagcccgugaaguucaccccuguuggacugaaugauauugaacauuuuaaccaguggguggucccgcgcuaugccggcgcccuuaaucugaacacgaaucucgcucccuccguggccccuguuuuccccggcgagagacugcuguuuuuccggucuuacaucccucuuaaagggggauauggcaaccccgcgauugacugccuccugccucaagagugggugcagcacuuuuaccaggaagcugcccccagcauguccgaggucgcccuggugcgcuauaucaauccggauacagggagagcucucuucgaagccaagcugcaccgggcuggauuuaugaccgugagcucuaacaccuccgccccuguugucgugcccgcgaacggcuacuucagauuugacagcugggugaaucaguucuauucucuugccccuauggggacaggcaacggacgccggagaguccaauga

SEQ ID NO: 28905 - RNA, 1629 nt, Artificial Sequence
  derived and/or modified sequence opt5 from VP1__Norovirus_and/or_Norovirus-like__LC145792
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaccuucaugauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaaguucacgcccguggggcucaacgauacagaccauuuuaaucaguggguucugccucgcuaugccggagcucuuaaccugaauaccaaccucgccccgagcguggcgcccgucuucccuggcgaaagacugcuguuuuuccgguccuacaucccccugaaaggcggguauggaaccccugcuauugauugccuccugccccaagagugggugcagcacuuuuaccaggaggccgccccuucuaugagcgaaguggcucugguucgcuauaucaaucccgacacaggcagagcccucuucgaggcuaagcugcaccgggccggguuuaugaccgucuccagcaacacaucugcgccggugguggucccugccaacggauacuucagauuugauuccugggugaaucaguucuauagccuugcucccaugggcacggggaacggccgccggcggauucaauga

SEQ ID NO: 28906 - RNA, 1629 nt, Artificial Sequence
  derived and/or modified sequence opt5 from VP1__Norovirus_and/or_Norovirus-like__LC145786
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauagccaaaaggaugacccuaaaaugcgcaucgucgcuaugcuguacacaccccuuagauccaacggaucuggcgaugacguuuucaccgugagcugccgggugcugacccgccccuccccugauuuugacuucacguaucucgucccgcccaccguggaaagcaagacaaaaccuuuuacccugcccauccugacacucggggagcugucuaauuccagauucccuguuagcauugaucagauguacaccucucccaacgaggugaucuccguccagugucagaacggacggugcacgcuugacggcgaacugcaagggacaacccagcuccaggugagcggaauuugugccuuuaagggcgagguuacagcccaucugcacgauaaugaccaccuuuauaacgugaccaucaccaaucugaacggcucuccguucgacccuuccgaagauauucccgcuccucucgggguccccgacuuccagggacgcguguuuggcgucaucagccaaagagauaagcacaauacaccugggcauaacgagcccgcgaaucgggcccacgacgcugugguuccgacguacaccgcccaguacacaccuaaacugggacagauucaaaucggcaccuggcagacagaugaccugaccgugaaccagcccgucaaguucacgcccguggggcucaaugauacagaccauuuuaaccaguggguugugccucgcuaugccggagcucugaaucuuaacaccaaucuggccccguccgucgcgcccguguucccuggcgaaagacuccuguuuuuccggucuuacaucccccuuaaaggcggguauggaaccccugcuauugauugccugcucccccaagagugggugcagcacuuuuaccaggaggccgccccuagcauguccgaaguugcucugguccgcuauaucaaccccgacacaggcagagcccuguucgaggcuaagcuccaccgggccggguuuaugaccgugagcucuaauacauccgcgccgguggucgugccugccaacggauacuucagauuugauagcuggguuaaccaguucuauucucuggcucccaugggcacggggaauggccgccggcggauucaauga

SEQ ID NO: 28907 - RNA, 1629 nt, Artificial Sequence
  derived and/or modified sequence opt5 from VP1__Norovirus_and/or_Norovirus-like__LC145793
augaagauggccagcaacgacgcugcccccuccaccgauggcgcggcugggcuggugccugagucuaauaacgaagucauggcccucgagccgguugccggaguggcucuggccgcucccgugacaggccagacgaauaucauugacccuuggaucagagccaacuucguccaagcgcccaauggggaauuuaccgugagcccuagaaacucccccggagagguucuucugaaucucgaacugggcccugagcuuaacccguaccuggcccaccucgcucgcauguauaauggguacgccggaggcauggaggugcaggucaugcuggcuggcaacgccuucacagcggggaaacugguguuugccgcuguucccccucauuuccccguggaaaaucucucuccucagcagauuaccauguuuccccacgucaucauugaugugagaacacuggagccggugcuucugccucuccccgacguccggaacaauuucuuucauuauaaccaaaaggaugacccuaaaaugcgcaucguugccaugcuguacacaccccuuagaagcaauggauccggcgaugacguguucaccgugucuugccggguccugacccgccccagcccugauuuugacuucacguaucucgugccgcccaccguugaauccaagacaaaaccuuuuacccugcccauccugacacucggggagcugagcaacucuagauucccuguguccauugaucagauguacaccagccccaacgaggucaucucugugcagugucagaauggacggugcacgcuugacggcgaacugcaagggacaacccagcuccagguuuccggaauuugugcuuuugagggcgaagugacagcccaucugcacgauaacgaccaccuuuauaaugucaccaucaccaaccugaauggcagcccguucgacccuucugaggauauucccgccccucucggggugcccgacuuccagggacgcgucuuuggcgugaucucccaaagagauaagcacaacacaccugggcauaaugaacccgcuaaccgggcgcacgacgccguugugccgacguacaccgcucaguacacaccuaagcugggacagauucaaaucggcaccuggcagacagaugaccugaccgucaaucagcccgugaaauucacgcccguugggcucaacgauacagaccauuuuaaucaguggguggucccucgcuaugccggagcccugaaccuuaauaccaaccuggcuccgagcguggcccccguguucccuggcgagagacuccuguuuuuccgguccuacaucccccuuaagggcggguauggaaccccugcgauugauugccugcucccccaagaguggguucagcacuuuuaccaggaagcugccccuucuaugagcgaggucgcccuggugcgcuauaucaaucccgacacaggcagagcucuguucgaagccaaacuccaccgggcuggguuuaugaccguguccagcaacacaucugccccggucgugguuccugcgaacggauacuucagauuugauuccugggugaaucaguucuauagccuggcccccaugggcacggggaacggccgccggcggauucaauga

SEQ ID NO: 28908 - RNA, 1629 nt, Artificial Sequence
  derived and/or modified sequence opt5 from VP1__Norovirus_and/or_Norovirus-like__LC145791
augaagauggccagcaacgacguggcucccuccaccgauggcgccgcggggcuggucccugagucuaauaacgaaguuauggcucucgagccgguggccggagccgcucuggccgcucccgugacaggccagacgaauaucauugacccuuggaucagagccaacuucguccaagcgcccaauggggaauuuaccgugagcccuagaaacucccccggagagguucuucugaaucucgaacugggcccugagcuuaacccguaccuggcccaccucgcucgcauguauaauggguacgccggaggcauggaggugcaggucaugcuggcuggcaacgccuucacagcggggaaacugguguuugccgcuguucccccucauuuccccguggaaaaucucucuccucagcagauuaccauguuuccccacgucaucauugaugugagaacacuggagccggugcuucugccucuccccgacguccggaacaauuucuuucauuauaaccaaaaggaugacccuaaaaugcgcaucguugccaugcuguacacaccccuuagaagcaauggauccggcgaugacguguucaccgugucuugccggguccugacccgccccagcccugauuuugacuucacguaucucgugccgcccaccguugaauccaagacaaaaccuuuuacccugcccauccugacacucggggagcugagcaacucuagauucccuguguccauugaucagauguacaccagccccaacgaggucaucucugugcagugucagaauggacggugcacgcuugacggcgaacugcaagggacaacccagcuccagguuuccggaauuugugcuuuuaagggcgaggugacagcccaucugcacgauaacgaccaccuuuauaaugucaccaucaccaaccugaauggcagcccguucgacccuucugaagauauucccgccccucucggggugcccgacuuccagggacgcgucuuuggcgugaucucccaaagagauaagcacaacacaccugggcauaaugagcccgcuaaccgggcgcacgacgccguugugccgacguacaccgcucaguacacaccuaaacugggacagauucaaaucggcaccuggcagacagaugaccugaccgucaaucagcccgugaaguucacgcccguugggcucaacgauacagaccauuuuaaucaguggguggucccucgcuaugccggagcccugaaccuuaauaccaaccuggcuccgagcguggcccccguguucccuggcgaaagacuccuguuuuuccgguccuacaucccccuuaaaggcggguauggaaccccugcgauugauugccugcucccccaagaguggguucagcacuuuuaccaggaggcugccccuucuaugagcgaagucgcccuggugcgcuauaucaaucccgacacaggcagagcucuguucgaggccaagcuccaccgggcuggguuuaugaccguguccagcaacacaucugccccggucgugguuccugcgaacggauacuucagauuugauuccugggugaaucaguucuauagccuggcccccaugggcacggggaacggccgccggcggauucaauga

SEQ ID NO: 28909 - RNA, 1629 nt, Artificial Sequence
  derived and/or modified sequence opt5 from VP1__Norovirus_and/or_Norovirus-like__LC145788
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccuggccgugaaucagcccgucaaguucacccccguggggcucaacgauacggaccauuuuaaucaguggguugugccucgcuaugcuggagcccugaaccuuaauacaaaccuggcgccgagcgucgcucccguguucccuggcgaaagacuccuguuuuuccgguccuacaucccccuuaaaggcggguauggaaccccugccauugauugccugcucccccaagagugggugcagcacuuuuaccaggaggccgcuccuucuaugagcgaaguugcccugguccgcuauaucaaucccgacaccggcagagcucuguucgaggccaagcuccaccgggcgggguuuaugacaguguccagcaacaccucugccccgguggucgugccugcuaacggauacuucagauuugauuccuggguuaaucaguucuauagccuggcccccaugggcacagggaacggccgccggcggauucaauga

SEQ ID NO: 28910 - RNA, 1629 nt, Artificial Sequence
  derived and/or modified sequence opt5 from VP1__Norovirus_and/or_Norovirus-like__LC145803
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcucuuucgacccguccgaagauauuccugcuccccucgggaucccugacuuccagggacgcgucuuuggcgugauuagccaaagagauaagcacaacacacccgggcauaaugagccugcgaaccgggcccacgacgcugucgugcccacguacaccgcccaguacacaccgaaacugggacagauccaaaucggcaccuggcagacagaugaccugaccguuaaucagccugugaaguucacgcccgucgggcucaacgauacagaccauuuuaaucagugggugguuccccgcuaugccggagcucugaaccuuaauaccaaccuggccccuuccguggcgccggucuuccccggcgaaagacuccuguuuuuccggucuuacauuccucuuaaaggcggguauggaacccccgcuaucgauugccugcucccucaagagugggugcagcacuuuuaccaggaggccgcccccagcauguccgaaguggcucugguucgcuauauuaauccugacacaggcagagcccuguucgaggcuaagcuccaccgggccggguuuaugaccgucagcucuaacacauccgcgcccgugguggucccggccaacggauacuucagauuugauagcugggugaaucaguucuauucucuggcuccuaugggcacggggaacggccgccggagaauccaauga

SEQ ID NO: 28911 - RNA, 1629 nt, Artificial Sequence
  derived and/or modified sequence opt5 from VP1__Norovirus_and/or_Norovirus-like__LC145804
augaagauggccagcaacgacgcugcccccuccaccgauggcgcggcugggcuggugccugagucuaauagcgaagucauggcccucgagccgguugccggagcugcccuggcugcccccgugacaggccagacgaacaucauugacccuuggaucagagcgaauuucgugcaagcccccaacggggaauuuaccgucuccccuagaaauucucccggagaggugcuucugaaccucgaacugggcccugagcuuaauccguaccuggcucaccucgcccgcauguauaacggguacgcuggaggcauggagguucaggugaugcuggccggcaaugcguucacagccgggaaacuggucuuugcugccgugcccccucauuuccccguugaaaaccucagcccucagcagauuaccauguuuccccacgugaucauugaugucagaacacuggagccggugcuucugccucuccccgacgugcggaauaacuucuuucauuauaaucaaaaggaugacccuaaaaugcgcaucgucgcuaugcuguacacaccccuuagauccaacggaucuggcgaugacguuuucaccgugagcugccgggugcugacccgccccuccccugauuuugacuucacguaucucgucccgcccaccguggaaagcaagacaaaaccuuuuacccugcccauccugacacucggggagcugucuaauuccagauucccuguuagcauugaucagauguacaccucucccaacgaggugaucuccguccagugucagaacggacggugcacgcuugacggcgaacugcaagggacaacccagcuccaggugagcggaauuugugccuuuaagggcgagguuacagcccaucugcacgauaaugaccaccuuuauaacgugaccaucaccaaucugaacggcucuccguucgacccuuccgaagauauucccgcuccucucgggguccccgacuuccagggacgcguguuuggcgucaucagccaaagagauaagcacaauacaccugggcauaacgagcccgcgaaucgggcccacgacgcugugguuccgacguacaccgcccaguacacaccuaaacugggacagauucaaaucggcaccuggcagacagaugaccuggccgugaaccagcccgucaaguucacccccguggggcucaaugauacggaccauuuuaaccaguggguugugccucgcuaugcuggagcccugaaucuuaacacaaaucuggcgccguccgucgcucccguguucccuggcgaaagacuccuguuuuuccggucuuacaucccccuuaaaggcggguauggaaccccugccauugauugccugcucccccaagagugggugcagcacuuuuaccaggaggccgcuccuagcauguccgaaguugcccugguccgcuauaucaaccccgacaccggcagagcucuguucgaggccaagcuccaccgggcgggguuuaugacagugagcucuaauaccuccgccccgguggucgugccugcuaacggauacuucagauuugauagcuggguuaaccaguucuauucucuggcccccaugggcacagggaauggccgccggcggauucaauga

SEQ ID NO: 28912 - RNA, 1629 nt, Artificial Sequence
  derived and/or modified sequence opt5 from VP1__Norovirus_and/or_Norovirus-like__LC145801
augaagauggccagcaacgacgcugcccccuccaccgauggcgcggcugggcuggugccugagucuacaaaugaagucauggcccucgagccgguugccggagcugcccuggcugcccccgugacgggccagaccaacaucauugacccuuggaucagagcgaauuucgugcaagcccccaacggggaauuuacagucagcccuagaaauucccccggagaggugcuucugaaccucgaacugggcccugagcuuaauccguaccuggcucaccucgcccgcauguauaacggguacgcuggaggcauggagguucaggugaugcuggccggcaaugcguucaccgccgggaaacuggucuuugcugccgugcccccucauuuccccguugaaaaccucucuccucagcagauuacaauguuuccccacgugaucauugaugucagaacccuggagccggugcuucugccucuccccgacgugcggaauaacuucuuucauuauaaucaaaaggaugacccuaaaaugcgcaucgucgcuaugcuguacacaccccuuagaagcaacggauccggcgaugacguuuucaccgugucuugccgggugcugacgcgccccagcccugauuuugacuucaccuaucucgucccgcccacaguggaauccaagaccaaaccuuuuacacugcccauccugacccucggggagcugagcaauucuagauucccuguuuccauugaucagauguacacgagccccaacgaggugaucucuguccagugucagaacggacggugcacacuugacggcgaacugcaagggaccacacagcuccagguguccggaauuugugccuuuaagggcgagguuaccgcccaucugcacgauaaugaccaccuuuauaacgugaccaucacaaaucugaacggcagcccguucgacccuucugaagauauucccgcuccucucggggcgcccgacuuccagggacgcgucuuuggcgugaucucccaaagagauaagcacaauacgccugggcauaacgagcccgccaaucgggcucacgacgccgucgugccgaccuacacagcccaguacaccccuaaacugggacagauucaaaucggcacauggcagaccgaugaccugacgguuaaccagcccgugaaguucacacccgucgggcucaaugauaccgaccauuuuaaccagugggugguuccucgcuaugcuggagcccugaaucuuaacaccaaucuggcgccgagcguggcucccgucuucccuggcgaaagacuccuguuuuuccgguccuacaucccccuuaaaggcggguauggaaccccugccauugauugccugcucccccaagagugggugcagcacuuuuaccaggaggccgcuccuucuaugagcgaaguggcccugguucgcuauaucaaccccgacacaggcagagcucuguucgaggccaagcuccaccgggcgggguuuaugacagucuccagcaauacgucugccccggugguggucccugcuaacggauacuucagauuugauuccugggugaaccaguucuauagccuggcccccaugggcaccgggaauggccgccggcggauucaauga

SEQ ID NO: 28913 - RNA, 1629 nt, Artificial Sequence
  derived and/or modified sequence opt5 from VP1__Norovirus_and/or_Norovirus-like__LC145802
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaaugggcaugcuggaggcauggagguucaggugaugcuggccggcaacgcguucacagccgggaaacuggucuuugcugccgugcccccucacuuccccguugaaaaucucucuccucagcagauuaccauguuuccccaugugaucauugaugucagaacacuggagccggugcuucugccucuccccgacgugcggaacaauuucuuucacuacaaccaaaaggaugacccuaaaaugcgcaucgucgcuaugcuguauacaccccuuagaagcaauggauccggcgaugacguuuucaccgugucuugccgggugcugacccgccccagcccugauuuugaguucacguaccucgucccgcccaccguggaauccaagacaaaaccuuuuacccugcccauccugacacucggggagcugagcaacucuagauucccuguuuccauugaccagauguauaccagccccaacgaagugaucucuguccagugucagaauggacggugcacgcuugauggcgagcugcaagggacaacccagcuccaggccuccggaauuugugccuuuaagggcgaagugacagcucaucugcacgacaacgaucaccuuuacaauguuaccaucaccaaccugaauggcagcccguucgacccuucugaggacauucccgcgccucucggggugcccgauuuccagggacgcgucuuuggcgugaucucccaaagagacaagcauaacgccccugggcacaaugaacccgcuaaccgggcccaugaugccgucgugccgacauauacggcucaguacaccccuaaacugggacagauucaaaucggcacauggcagaccgacgaucugacaguuaaucagcccgugaaguucacccccgucgggcucaacgacacggaucacuuugaccagugggugguuccucgcuacgccggagcgcugaaucuuaacacaaaucuggcuccgagcguggcccccgucuucccuggcgagagacuccuguuuuuccgguccuauaucccccuuaaaggcggguacggaaccccugccauugauugccugcucccccaagagugggugcagcacuuuuaucaggaagcugccccuucuaugagcgagguggcucugguucgcuacaucaaccccgacaccggcagagcccuguucgaagcgaagcuccaucgggccggguuuaugacagucuccagcaauaccucugcuccggugguggucccugccaacggauauuucagauuugauuccugggugaaccaguucuacagccuggcucccaugggcacagggaauggccgccggcggauucaauga

SEQ ID NO: 28914 - RNA, 1629 nt, Artificial Sequence
  derived and/or modified sequence opt5 from VP1__Norovirus_and/or_Norovirus-like__LC145805
augaagauggccagcaacgacgcugcccccuccaccgauggcgcggcugggcuggugccugagucuaauagcgaagucauggcccucgagccgguugccggagcugcccuggcugcccccgugacaggccagacgaacaucauugacccuuggaucagagcgaauuucgugcaagcccccaacggggaauuuaccgucuccccuagaaauucucccggagaggugcuucugaaccucgaacugggcccugagcuuaauccguaccuggcucaccucgcccgcauguauaacggguacgcuggaggcauggagguucaggugaugcuggccggcaaugcguucacagccgggaaacuggucuuugcugccgugcccccucauuuccccguugaaaaccucagcccucagcagauuaccauguuuccccacgugaucauugaugucagaacacuggagccggugcuucugccucuccccgacgugcggaauaacuucuuucauuauaaucaaaaggaugacccuaaaaugcgcaucgucgcuaugcuguacacaccccuuagauccaacggaucuggcgaugacguuuucaccgugagcugccgggugcugacccgccccuccccugauuuugacuucacguaucucgucccgcccaccguggaaagcaagacaaaaccuuuuacccugcccauccugacacucggggagcugucuaauuccagauucccuguuagcauugaucagauguacaccucucccaacgaggugaucuccguccagugucagaacggacggugcacgcuugacggcgaacugcaagggacaacccagcuccaggugagcggaauuugugccuuuaagggcgagguuacagcccaucugcacgauaaugaccaccuuuauaacgugaccaucaccaaucugaacggcucuccguucgacccuuccgaagauauucccgcuccucucgggguccccgacuuccagggacgcguguuuggcgucaucagccaaagagauaagcacaauacaccugggcauaacgagcccgcgaaucgggcccacgacgcugugguuccgacguacaccgcccaguacacaccuaaacugggacagauucaaaucggcaccuggcagacagaugaccuggccgugaaccagcccgucaaguucacccccguggggcucaaugauacggaccauuuuaaccaguggguugugccucgcuaugcuggagcccugaaucuuaacacaaaucuggcgccguccgucgcucccguguucccuggcgaaagacuccuguuuuuccggucuuacaucccccuuaaaggcggguauggaaccccugccauugauugccugcucccccaagagugggugcagcacuuuuaccaggaggccgcuccuagcauguccgaaguugcccugguccgcuauaucaaccccgacaccggcagagcucuguucgaggccaagcuccaccgggugggguuuaugacagugagcucuaauaccuccgcgccggucgugguuccugccaacggauacuucagauuugauagcugggugaaccaguucuauucucuggcucccaugggcacagggaauggccgccggcggauucaauga

SEQ ID NO: 28915 - RNA, 1629 nt, Artificial Sequence
  derived and/or modified sequence opt5 from VP1__Norovirus_and/or_Norovirus-like__LC145797
augaagauggccagcaacgacgcugcccccuccaccgauggcgcggcugggcuggugccugagucuaauaacgaagucauggcccucgagccgguugccggaguggcucuggccgcucccgugacaggccagacgaauaucauugacccuuggaucagagccaacuucguccccgcgccuaauggggaauuuaccgugagcccccggaacuccccuggagagguucuucugaaucucgaacugggcccggagcuuaaccccuaccuggcccaccucgcucgcauguauaauggguacgccggaggcauggaggugcaagucaugcuggcuggcaacgccuucacagcggggaaacugguguuugccgcuguuccuccccauuucccuguggaaaaucucucuccccagcagauuaccauguuuccgcacgucaucauugaugugagaacacuggagccugugcuucugccccucccugacguccggaacaauuucuuucauuauaaccagaaggaugaccccaaaaugcgcaucguugccaugcuguacacaccccuuagaagcaauggauccggcgaugacguguucaccgugucuugccggguccugacccgcccuagcccggauuuugacuucacguaucucgugcccccuaccguugaauccaagacaaaacuguuuacccugcccauccucacacugggggagcuuagcaacucuagauucccuguguccauugaucaaauguacaccagccccaacgaggucaucucugugcagugucagaauggacggugcacgcuggacggcgaacuccaggggacaacccaacugcagguuuccggaauuugugcuuuuaagggcgaggugacagcccaccuucaugauaacgaccaccuguauaaugucaccaucaccaaccucaauggcagcccguucgacccuucugaagauauucccgccccucugggggugcccgacuuccagggacgcgucuuuggcgugaucucccagagagauaagcacaacauuagcgggcauaaugagccugcuaaccgggcgcacgacgccguugugcccacauacacggcucaauacaccccgaaacugggacagauccagaucggcacauggcaaaccgaugaccucacagucaaucagccugugaaguucacccccguugggcugaacgauacggaccauuuuaaucaguggguggucccccgcuaugccggagcccuuaaccugaauacaaaccucgcuccuuccguggccccgguguuccccggcgaaagacugcuguuuuuccggucuuacauuccucuuaaaggcggguauggaacccccgcgaucgauugccuccugccucaggaguggguucaacacuuuuaccaggaggcugcccccagcauguccgaagucgcccuggugcgcuauauuaauccugacaccggcagagcucucuucgaggccaagcugcaccgggcuggguuuaugacagugagcucuaacaccuccgcccccgucgugguuccggcgaacggauacuucagauuugauagcugggugaaucaguucuauucucuugccccuaugggcacagggaacggccgccggagaauccaguga

SEQ ID NO: 28916 - RNA, 1629 nt, Artificial Sequence
  derived and/or modified sequence opt5 from VP1__Norovirus_and/or_Norovirus-like__LC145806
augaagauggccagcaacgacgcugcccccuccaccgauggcgcggcugggcuggugccugagucuaauagcgaagucauggcccucgagccgguugccggagcugcccuggcugcccccgugacaggccagacgaacaucauugacccuuggaucagagcgauuuucgugcaagcccccaauggggaauuuaccgucuccccucggaacucucccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucagcccucagcagaucaccauguuuccccacgugauuaucgaugucagaacacuggagccggugcuucugccucuccccgacgugcggaacaauuucuuucauuauaaccaaaaggaugacccuaaaaugcgcaucgucgcuaugcuguacacaccccuuagauccaauggaucuggcgaugacguuuucaccgugagcugccgggugcugacccgccccuccccugauuuugacuucacguaucucgucccgcccaccguggaaagcaagacaaaaccuuuuacccugcccauucugacacucggggagcugucuaacuccagauucccuguuagcaucgaucagauguacaccucucccaaugaggugauuuccguccagugucagaacggacggugcacgcuugacggcgaacugcaagggacaacccagcuccaggugagcggaaucugugccuuuaagggcgagguuacagcccaucugcacgauaacgaccaccuuuauaaugugaccauuaccaaccugaauggcucuccguucgacccuuccgaagauauccccgcuccucucgggguccccgacuuccagggacgcguguuuggcgucauuagccaaagagauaagcacaacacaccugggcauaaugagcccgcgaaccgggcccacgacgcugugguuccgacguacaccgcccaguacacaccuaaacugggacagauccaaaucggcaccuggcagacagaugaccuggccgugaaucagcccgucaaguucacccccguggggcucaacgauacggaccauuuuaaucaguggguugugccucgcuaugcuggagcccugaaccuuaauacaaaccuggcgccguccgucgcucccguguucccuggcgaaagacuccuguuuuuccggucuuacauuccccuuaaaggcggguauggaaccccugccaucgauugccugcucccccaagagugggugcagcacuuuuaccaggaggccgcuccuagcauguccgaaguugcccugguccgcuauauuaaucccgacaccggcagagcucuguucgaggccaagcuccaccgggcgggguuuaugacagugagcucuaacaccuccgccccgguggucgugccugcuaauggauacuucagauuugauagcuggguuaaccaguucuauucucuggcccccaugggcacagggaacggccgccggagaauccaauga

SEQ ID NO: 28917 - RNA, 1629 nt, Artificial Sequence
  derived and/or modified sequence opt5 from VP1__Norovirus_and/or_Norovirus-like__KU306738
augaagauggccagcaacgacgcugcccccuccaaugauggcgcgucuagccuggugccugagaucaacaaugaaaccauggcucucgagccgguggccgggggagccauugcugcuccccugacaggccagacgaacuucaucgacccuuggauuagaaauaacuacguucaagcccccaauggggaauuuaccaucuccccucggaacucucccggagagauucuucugaaucucgaacugggcccugagcuuaacccguuccuggcccaccucgcgcgcauguauaauggguacgccggaggcguggaugugcaggucaucauggcuggcaacgccuuuacagcugggaaagugaucuucgccgcgguucccccucauuuucccguggagagccuguccccuccccagauuaccauguucccgcacaucauugucgacgugagaacacuggaaccuaucaauauucccaucccugauguucggaacaacuuuuuccauuauaaucagaacaaugagccccgcaugagacucguggccaugcuguacacaccccuucggucuaacggaagcgcugacgaugucuuuaccguguccugccgcgugcugaccaagccuagcgccgacuucgaauuuaauuaucucgucccgcccacgguugagucuagaaccaaaccuuucacaauucccauccugaccaucggcgagaugacaaacucccgguuuccuguggcuauugauaugcuuuacaccagccccacggaaaaucuggugguccaaccgcagaacgggcgcuguacacucgagggagaacugcugggcaccacacagcucgugaccccuaauaucugcucucugagaggggccauuaccggacacgagggcaacgacgauaaucauaaguggcacaugacaguuacgaaccccaauggcuccgccuucgacccuaccgaagaugugcccgcuccucuugggacacccgacuucaucggagacgucuauggcgugcugagccagcggaaccgcaauauugagucugggcaaaccgcgccggccaacagaucccacgaggcuguuaucagcacacgguccaauaaauuuaccccuaagcucggaucugugaugaucgccacguggaacacaaacgaugucgaaaaucagcccaccaaguucacccccgugggccuggagaacccugggagcuuucaucagugggaacuuccgaauuacuccggagcccugacacucaacaugggccuggcucccccugucuuccccaccuacccuggcgagcagcugcucuuuuuccgcagcuauauuccccugaaagggggauuuggcaauucuaucauugacugucuugugccucaagaauggauccagcacuucuaccaggaguccgcccccagccaaacagauguugcgcugauuagauaugugaacccggagacggggcggguccucuuugaagcuaagcugcauagacagggauucaucaccguggccaaaacaggcgacucuccuaucaauguucccgccaacggguacuuucgcuucgauagcugggucaauuccuuuuauucucuugcuccuaugggcaccggaaacggccggagacgcauucaguga

SEQ ID NO: 28918 - RNA, 1629 nt, Artificial Sequence
  derived and/or modified sequence opt5 from VP1__Norovirus_and/or_Norovirus-like__KM036380
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaagauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggacgcuuuacaccgaagaucggcaccauugggcugcauagcaucacggaaaaugugcacccuaaccagcaaucuagauucacacccgucggaguggcccagaaugagaacacccccuuccagcaguggguccuuccucauuaugccggcgcucuggcccucaauaccaaccuggcgccggcuguggcccccacauuuccuggcgagcaacuucuguucuuucggucccgcguucccugcgugcaggggcucagaggacaggacgccuucaucgauugucugcugccucaggaaugggucaaucacuuuuaccaagaggcugcccccagccaggcugacguggcccucauucgguauguuaacccugauaccggcagaacacuguucgaagcgaaacuucaccgcucuggguuuaucacggugagccauaccggaaacuacccccuggucgugccgccuaauggccacuuccgguuugacuccugggugaaccaguucuauucucucgcccccauggggacaggcaauggaagacgccggguucaguga

SEQ ID NO: 28919 - RNA, 1629 nt, Artificial Sequence
  derived and/or modified sequence opt5 from VP1__Norovirus_and/or_Norovirus-like__AY113106
augaagauggccagcaacgacgcugcccccuccaaugauggcgcggcuucucuggugccugaggggaucaacgaaaccaugccgcucgagcccgucgccggagccagcauugcugccccuguugcuggccagacaaauaucauugaccccuggaucagaacgaacuucgugcaagccccuaauggggaauuuaccgugucuccccggaacuccccuggagagauucugcuuaaucuggaacucggcccggaucugaaccccuaccuugcgcaccugagccgcauguauaauggguacgccggaggcgucgaggugcagguucuccuggcuggcaacgccuucacagcugggaaaauccuguuugccgcgaucccucccaauuucccuguggacaugauuucccccgcccagaucaccaugcucccgcaucugauugucgaugugagaacacuugagccuaucaugauuccccugccugacguucggaacguguuuuaucacuucaauaaccagccccaaccccgcaugagacucgucgcuaugcuguacaccccucuucggucuaauggaagcggcgaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcccccaacgagacgaaugugguccagugucagaacgggcgcugcacacuugacggagaacugcaaggcaccacacagcuccugucuuccgcuguguguagcuauagagggcggaccguugccaauaacggagauaauugggaccagaaccuucugcagcucaccuacccuaauggcgccucuuacgaucccacagacgaggugccugcuccccugggcacgcaagacuucuccgggaugcuguauggaguccucacccaggauaacgugaauguuagcacaggcgaagcgaagaacgccaaagggaucuacauuuccaccacaucuggaaaguuuaccccgaaggugggcagcaucgggcugcauuccauuacggagcacguccauccuaaucagcaaagccgcuucacacccgugggagucgcugugaacgaaaauacccccuuccagcaguggguucuuccucacuaugccggcucucuggcccucaacaccaaucuggcuccggccguggcgcccacauuuccuggcgagcagcuucuguucuuuagaucccggguccccugcgugcaagggcuccagggacaggacgcuuucaucgauugucugcugccucaggaguggguuaaccacuuuuaccaagaagccgcccccagccaggcugacguggcccucauccgcuaugucaacccugauaccggcagaacacuguucgaggcuaaacuucaucggucuggguuuauuacggugagccacaccggagccuacccccuggugguuccgccuaauggccauuucagauuugacuccugggucaaccaguucuauucucucgcgcccauggggacaggcaauggacgccggagaauccaguga

SEQ ID NO: 28920 - RNA, 1629 nt, Artificial Sequence
  derived and/or modified sequence opt5 from VP1__Norovirus_and/or_Norovirus-like__AB078334
augaagauggccagcaacgacgcugcccccuccaaugauggcgcggcuucucuggugccugaggggaucaacgaaaccaugccgcucgagcccgucgccggagccagcauugcugccccuguugcuggccagacaaauaucauugaccccuggaucagaacgaacuucgugcaagccccuaauggggaauuuaccgugucuccccggaacuccccuggagagauucugcuuaaucuggaacucggcccggaucugaaccccuaccuugcgcaccugagccgcauguauaauggguacgccggaggcgucgaggugcagguucuccuggcuggcaacgccuucacagcugggaaaauccuguuugccgcgaucccucccaauuuccucguggacaugauuuccccugcccagaucaccaugcugccccaucuuauugucgaugugagaacacuggagccgaucaugaccccucuccccgacguucggaacguguuuuaucacuucaauaaccagccucaaccccgcaugagacuggucgcuaugcuuuacacaccccugcggucuaauggaagcggcgaugacguguuuaccguguccugccgcguccucacgagaccuaccccggauuucgaauuuauuuaucugguucccccuagcguggagucuaagacaaaacccuucacccugccuauccucacaauuuccgaacugaccaacagccgguuucccaucccgaucgagcagcuuuacacggccccuaacgagacaaaugugguccagugucagaacgggcgcugcacccuggacggagaacuccaaggcacaacccagcugcuuucuuccgcuguguguuuccugcaggggagaaccguugccgauaauggagacaacugggaucagaaucuccugcaacugacauaucccaacggcgccagcuacgacccuacggacgaggugcccgcuccucucggcacccaggauuuuucugggaugcuguacggaguccuuacacaggacaaugugaacguuuccaccggcgaagcgaagaaugccaaagggauuuauaucagcacaaccuccggaaaguucacgcccaagauuggcucuaucgggcugcauagcauuacagagcacgugcauccgaaccaacagucccgguucaccccugucggaguggcugucgaugaaaauacccccuuucagcagugggugcucccccacuacgccggcagccuggcccuuaacacaaaucuggcuccugccguugcgccgaccuuccccggcgagcaacuccuguuuuuccgcucuagagugccuugcguccaggggcugcagggacaggacgcuuuuaucgauugucuccugccccaagagugggugaaccacuucuaucaggaagccgccccuucccaggcugacguugcccuuauccgguacgugaaucccgauacaggccgcacgcuguuugaggcuaaacuccauagaagcggguucauuaccgucucucacacaggagccuauccucugguggugcccccgaacggccauuuucgguucgacagcuggguuaaccaguuuuacucccuggcgccuauggggaccggcaauggaagacgccggauccaauga

SEQ ID NO: 28921 - RNA, 1629 nt, Artificial Sequence
  derived and/or modified sequence opt5 from VP1__Norovirus_and/or_Norovirus-like__KM289172
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaagugaucuucgcugccauucccccuaacuuucccaccgacaaucuguccgcugcccagauuacaaugugcccucaugucaucguggauguucgccaacuggagcccauuaaccucccgaugccugacgugagaaauaacuucuuucacuauaaccagggcucugauagccggcugcgccuuaucgccaugcuguacacaccccucagagcuaauaacuccggggacgaugucuucaccgugucuugucgggugcugacccgcccuagccccgacuuuuccuucaauuuucuuguucccccuacagucgaaagcaagaccaaaccguucacgcugcccauucucaccaucucugagauguccaacagcagauuuccugugcccauugauucucugcauacauccccuaccgacaauaucgugguccagugccagaacggacgggugacacuggauggcgaacucauggggaccacgcaacugcuucccagccagaucugugcguuccgcggaguucugacaagaucuaccucccgggccagcgaccaggcugacacagccaccccgcgccucuucaauuauuacuggcacauucagcuggauaaccuuaauggcaccccuuaugaccccgccgaggauaucccugcuccccugggcacaccugacuuuagagggaagguguucggagucgccucccaacggaaccccgauucuacgacccgcgcgcaugaggcuaaaguggacacaaccagcggcagauuuacaccgaagcucgggucccuggaaauuagcaccgagucuggagauuucgaccagaaucagccuacgcgguuuacacccguuggcaucgggguggauuccgaagccgacuuccaacaguggacccugcccgauuacagcggacaguuuacccacaacaugaaucucgccccugcugucgccccgaacuuccccggcgagcagcugcuguuuuucagaucucaacuuccuagcuccggcgggcgcucuaauggaauccucgacugccuggugccccaggaauggguccagcacuuuuaccaggagagcgcuccugcccaaacacagguggcgcuuguucgguaugugaaccccgacaccggcagaguccuguucgaggccaagcuccauaaacugggguacaugacaaucgcuaaguccggagauagcccuaucacggugcccccgaacggcuauuuucgcuucgaaucuuggguuaauccuuucuacacccuggcccccauggggacaggcaacuga

SEQ ID NO: 28922 - RNA, 1629 nt, Artificial Sequence
  derived and/or modified sequence opt5 from VP1__Norovirus_and/or_Norovirus-like__AY130762
augagaauggccagcuccgacgcucccgugucuggcaccgauggggccgcgggacuggucccugagagccagcaagaaguucucccgcuggagcccguggcuggcgugcagcuugccgccccugucgcugggcaguccaacaucauugaccccuggauccggaugaauuucgugcaggccccugcuggagaauuuacaguuucuccccgcaacgccccuggcgaggugcugauugaucucgaacuggggccggagcuuaaucccuaccugaaccaccucgcgagaauguauaauggauacgucggcggcauggagguggaaguugugcuggccgggaacgcuuucacggccggaaagauccuguuugcugccgucccucccagcuucccuacccauggcauuuccgcggcccaagcuacaaugcucccccacgugaucguggacguccggcagcuggagccgguucgccuuccucugcccgaugugagaaaugugauguuucauuucugccaggaaaacaaagagccucggaugcgcaucgucgccauucucuauacaccccugagagcuaauggggccggagacgauguguuuaccguuucuugucgggugcuuacccgccccagcccugacuucgauuuuaucuuccuggucccgcccuccguggagagcaagcucaaacaguuuacacugccuaaccugcaacccaaugaaaugaccaacucuagauucccuacgggcauuacccagcucuacacaucccccaauaccaaccugguugugcaguuucagaaugggcggugccuucuggacggaacacuccugggcaccacgccgguccgcgccgcugauaucuguagcuucagaggcgugacaucuaccgaggucgacgcgacagauuccccucggguggccgggagccaccgcauuaugguucaacuuaaggaacccgacggagaggaguucucuccuaccggccccaacccugcucccguggggaccccggacuuucaggccgccaucuucggaacacugucccagagaaacacgggcggggcuggacaaaauagcaaccgggcccauuuugcguauuucuacaccagaaauccuacauuugcucccggcauuggcaccgucguguucuccuuugauacaaccgacuuccagaaccgccagcccacgaaauuuucuccuagcgggguuuucgaugacaauuccagcgaaccguuuaaccaguucucucuccccuauuacaauggaucccugggcgccguggaugccgggaagcuggcuccucccgucgccccuaacuaccccggagagcaaauccucuauuuucggggcaauaucccuuucaagggcggguacggagaaggcgagauugacagccugcuuccccaggaauggaucacacacuucuaugcugagcaggccccgacccagggggaugcggcccugcucagauacuauaacccugacaccggacgcgugcuguuugaaugcaaacuucaccgggagggcuucauuacaaucaauuacaccgggucuaacgcucuggccgugcccguuaauggagucuuuagauucgagggcugggugaacaaguuuuauacacucacgccuauguga

SEQ ID NO: 28923 - RNA, 1629 nt, Artificial Sequence
  derived and/or modified sequence opt5 from VP1__Norovirus_and/or_Norovirus-like__KJ196290
augagaauggccagcuccgacgcucccgugucuggcaccgauggggccgcgggacuggucccugagagccagcaagaaguucucccgcuggagcccguggcuggcgugcagcuugccgccccugucgcugggcaguccaacaucauugaccccuggauccggaugaauuucgugcaggccccugcuggagaauuuacaguuucuccccgcaacgccccuggcgaggugcugauugaucucgaacuggggccggagcuuaaucccuaccugaaccaccucgcgagaauguauaauggauacgucggcggcauggagguggaaguugugcuggccgggaacgcuuucacggccggaaagauccuguuugcugccgucccucccagcuucccuacccauggcauuuccgcggcccaagcuacaaugcucccccacgugaucguggacguccggcagcuggagccgguucgccuuccucugcccgaugugagaaaugugauguuucauuucugccaggaaaacaaggagccucggaugcgcaucgucgccauucucuauacaccccugagagcuaauggggccggagacgauguguuuaccguuucuugucgggugcuuacccgccccagcccugacuucgauuuuaucuuccuggucccgcccuccguggagagcaagcucaaacaguuuacacugccuaaccugcaacccaaugaaaugaccaacucuagauucccuacgggcauuacccagcucuacacaucccccaauaccaaccugguugugcaguuucagaaugggcggugccuucuggacggaacacuccugggcaccacgccgguccgcgccgcugauaucuguagcuucagaggcgugacaucuaccgaggucgacgcgacagauuccccucggguggccgggagccaccgcauuaugguucaacuuagagaacccgacggagaggaguucucuccuaccggccccaacccugcucccguggggaccccggacuuucaggccgccaucuucggaacacugucccagcggaacacgggcggggcuggacaaaauagcaacagagcccauuuugcguauuucuacacccgcaauccuacauuugcucccggcauuggcaccgucguguucuccuuugauacaaccgacuuccagaaccggcagcccacgaaguuuucuccuagcgggguuuucgaugacgauuccagcgaaccguuuaaucaguucucucuccccuauuacaacggaucccugggcgccguggacgccgggaaacuggcuccucccgucgccccuaauuaccccggagagcaaauccucuauuuuagaggcagcgugccuuucaaagggggcuacggagaaggcgagaucgauucucugcuuccccaggaauggauuacacacuucuaugcugagcaggccccgacccagggggacgcggcccugcuccgcuacuauaacccugauaccggacgggugcuguuugaaugcaaacuucacagagagggcuucaucacaauuaauuacaccgggagcaacgcucuggccguucccgucaauggaguguuucgcuucgagggcugggugaacaaguuuuauacacucacgccuauguga

SEQ ID NO: 28924 - RNA, 1629 nt, Artificial Sequence
  derived and/or modified sequence opt5 from VP1__Norovirus_and/or_Norovirus-like__GQ856474
augagaauggccagcuccgacgcucccgugucuggcaccgauggggccgcgggacuggucccugagagccagcaagaaguucucccgcuggagcccguggcuggcgugcagcuugccgccccugucgcugggcaguccaacaucauugaccccuggauccggaugaauuucgugcaggccccugcuggagaauuuacaguuucuccccgcgaugccccuggcgaggugcugauugaccucgaacuggggccggagcuuaaccccuaccugaaucaccucgcgagaauguauaacggauacgucggcggcauggagguggaaguugugcuggccgggaaugcuuucacggccggaaagauccuguuugcugccgucccucccagcuucccuacccauggcauuuccgcggcccaagcuacaaugcucccccacgugaucguggauguccggcagcuggagccgguucgccuuccucugcccgacgugagaaacgugauguuucauuucugccaggaaaauaaagagccucggaugcgcaucgucgccauucucuauacaccccugagagcuaacggggccggagaugacguguuuaccguuucuugucgggugcuuacccgccccagcccugauuucgacuuuaucuuccugguccucccguccguggagagcaagcugaaacaguuuacacugcccaaucuccaaccuaacgaaaugaccaauucuagauuccccacgggcauuauccagcuguacaccuccccuaacacaaaucuuguugugcaguuucagaacgggcggugccugcucgauggaacccugcuuggcacaacccccguccgcgccgcugacauuuguagcuucagaggcgugacgucuacagaggucgaugcgaccgacuccccgcggguggccgggagccaccgcaucaugguucaacugaaggaaccugacggagaggaguucucucccacaggcccuaaucccgcuccuguggggacccccgauuuucaggccgccauuuucggaacccucucccagagaaacacaggcggggcuggacaaaacagcaaucgggccagauuugcguauuucuacacgcgcaacccgaccuuugcuccuggcaucggcacagucguguucuccuuugacaccacagauuuccagaaucggcagcccaccaaauuuucucccagcgggguuuucgacgaugacuccagcgaaccuuuuaaccaguucucucugccguauuacaauggaucccugggcgccguggaugccgggaagcucgcucccccugucgcccccaacuacccuggagagcaaauccuguauuuuagaggcaauauucccuucaaagggggcuacggagaaggcgagaucgacagccuucugccucaggaauggauuacgcauuucuaugcugagcaggcccccacacagggggaugcggcccuccugcgcuacuauaacccggacaccggacgggugcuuuuugaaugcaagcugcacagagagggcuucaucaccauuaauuacacagggucuaacgcucucgccgugccuguuaauggagucuuucgcuucgagggcugggugaacaaguuuuauacccugacacccauguga

SEQ ID NO: 28925 - RNA, 1629 nt, Artificial Sequence
  derived and/or modified sequence opt5 from VP1__Norovirus_and/or_Norovirus-like__LC145787
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucccuguuuccauugaucagauguacaccagccccaacgaggugaucucuguccagugucagaacggacggugcacgcuugacggcgaacugcaagggacaacccagcuccagguguccggaauuugugccuuuaagggcgagguuacagcucaucugcacgauaaugaccaccuuuauaacgugaccaucaccaaucugaacggcagcccguucgacccuucugaagauguccccgcgccucucggggugcccgacuuccagggacgcgucuuuggcauuaucucccaaagagauaagcacaauagcccugggcauaacgagcccgccaaucggggacacgacgcugugguuccgacauacacggcccaguacaccccuaaacugggccagauucaaaucgggacauggcagaccgaugaccugacagugaaccagcccgucaaguucacccccgugggacucaaugauacggaacauuuuaaccaguggguugugccucgcuaugccggcgcucugaaucuuaacacaaaucuggccccguccgucgcgcccguguucccuggcgagagacuccuguuuuuccggucuuacgugccccuuaaagggggauauggcaacccugcuaucgacugccugcucccccaagaguggguucagcacuuuuaccaggaagccgccccuagcauguccgaggucgcucuggugcgcuauauuaaucccgauaccgggagagcccuguucgaagcuaagcuccaccgggccggauuuaugaccgugagcucuaacacauccgcgccggucgugguuccugccaacggcuacuucagauuugacagcugggugaaucaguucuauucucuggcucccauggggaccggcaacggacgccggagaguccaauga

SEQ ID NO: 28926 - RNA, 1629 nt, Artificial Sequence
  derived and/or modified sequence opt5 from VP1__Norovirus_and/or_Norovirus-like__AB629946
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucaccguuuccauugaucagauguacacgagccuuaacgaggugaucucuguccagugucagaacggacggugcacacuggacggcgaacuccgcgggaccacacaacuucagguguccggaauuugugccuuuaagggcgagguuaccgcucacgugcaugauaaugaccaccuguauaacgucaccaucacaaaucugaacggcagcccuuucgaccccucugaagaugugccggcgccucucgggguccccgacuuccagggaagaguguuuggcauuaucucccagcgggauaagcacaauagcccugggcauaacgagcccgccaaucgcggacacgacgcuguugugccuacguacaccgcccaauacacacccaaacugggccagauucagaucgggaccuggcaaacagaugaccugaccgucaaccagccggugaaguucacgccuguuggacucaaugauacagaacauuuuaaccagugggugguccccagauaugccggcgcucugaaucuuaacaccaaucuggcccccuccguggcgccuguguucccgggcgagcggcuccuguuuuuccgcucuuacguuccccuuaaagggggauauggcaacccugcuaucgacugccugcucccccaggaguggguccaacacuuuuaccaggaagccgccccuagcauguccgagguggcucuggugagauauauuaaucccgauaccgggcgggcccuguucgaagcuaagcuccacagagccggauuuaugacagucagcucuaacaccuccgcgccugugguugugcccgccaacggcuacuuccgcuuugacagcugggucaaucaguucuauucucuggcuccgauggggacaggcaacggacggagacgcgugcaguga

SEQ ID NO: 28927 - RNA, 1629 nt, Artificial Sequence
  derived and/or modified sequence opt5 from VP1__Norovirus_and/or_Norovirus-like__KT962983
augaagauggccagcaacgacgcugcccccuccaccgauggcgcggcugggcuggugccugagucuaauacagaagucauggcccucgagccgguugccggagcugcccuggcugcccccgugacgggccagaccaacaucauugacccuuggaucagagcgaauuucgugcaagcccccaacggggaauuuacagucagcccucggaaugcucccggagaggugcuucugaaccucgaacugggcccugagcuuaauccguaccuggcccaccucgcucgcauguauaacggguacgccggaggcauggagguucaggugaugcuggcgggcaaugccuucaccgcugggaaacuggucuuugccgcugugcccccucauuuccccguugaaaaccucuccccucagcagauuacaauguuuccccacgugaucauugaugucagaacccuggagccggugcuucugccucuccccgacgugcggaauaacuucuuucauuauaaucaaaaggaugacccuaaaaugcgcaucgucgccaugcuguacacaccccuuagaucuaacggaagcggcgaugacguuuucaccguguccugccgggugcugacgcgccccucuccugauuuugacuucaccuaucucgucccgcccacaguggaaagcaagaccaaaccuuuuacacugcccauccugacccucggggagcuguccaauagcagauucccuguuucuauugaucagauguacacgucccccaacgaggugaucagcguccagugucagaacggacggugcacacuugacggcgaacugcaagggaccacacagcuccaggugucuggaauuugugccuuuaagggcgagguuaccgcucaucugcacgauaaugaccaccuuuauaacaucaccauuacaaaucugaacggcuccccguucgacccuagcgaagauauccccgcgccucucggggugcccgacuuccagggacgcgucuuuggcauuaucucucaaagagauaagcacaauuccccugggcauaacgagcccgccaaucggggacacgacgcuguggucccgacguacaccgcccaguacacaccuaaacugggccagauccaaauugggaccuggcagacagaugaccugaccgugaaccagcccguuaaguucacgcccgugggacucaaugauacagaacauuuuaaccagugggucgugccucgcuaugccggcgcucugaaucuuaacaccaaucuggccccgagcguugcgcccguguucccuggcgagagacuccuguuuuuccgguccuacaucccccuuaaagggggauauggcaacccugcuauugacugccugcucccccaagaguggguccagcacuuuuaccaggaagccgccccuucuaugagcgagguggcucuggugcgcuauaucaaucccgauaccgggagagcccuguucgaagcuaagcuccaccgggccggauuuaugacaguuuccagcaacaccucugcgccggucguggugccugccaacggcuacuucagauuugacuccugggucaaucaguucuauagccuggcucccauggggacaggcaacggacgccggagagugcaauga

SEQ ID NO: 28928 - RNA, 1626 nt, Artificial Sequence
  derived and/or modified sequence opt5 from VP1__Norovirus_and/or_Norovirus-like__AB083780
augaagauggccagcaacgacgcugcccccuccaaugauggcgcggcugggcuggugccugagaucaacaccgaagucauggcccucgagccgguugccggaggcgcuauugccgcuccccugacagggcagacgaauaucauugacccuuggaucagaaacaauuucgugcaagcccccaacggagaauuuaccauuucuccucggaauagccccggcgagauccuucugaacauggaacucgggccugagcugaauccguuccuugcgcaccugucccgcauguacaacggauuugccggcggcauggaggugcagguccucauggcugggaaugccuucacagcuggaaaagugaucuuugccgcgguucccccucauuuccccguggaaaaccugucuccuccccagauuaccauguuuccgcacaucauuaucgaugucagaacacuggagccugugcuccugcccaugccugacguucggaaucaguucuuucauuauaaccaagugaaugaaccccgcaugagacuugucgccaugcuguacacaccccuccggagcaacggcuccaccgaggauguguucaccgugucuugccgcguccugacgagaccuagcccggacuuugaguucaacuaucuuguucccccuaccguggaaucccggacaaagcccuuuacccugccugugcucacaauuggggagaugaccaauagccgcuuccccgcuccgaucgauaugcuguacacgucuccuaacggaaaugucgugguucagccccagaacggcagauguacacuggacggggaacuccagggauccacccaacuggugccugccaaugucugcgcuuuccggggcaaaauuacagcccgcaucguggaucaggccgcucaccaguggcauaugcagaucgacaaccccaauggcacccuuuuugauccuaccgaggacguucccgcgccgcuggggacaccugauuucaaggccaaaauuuuuggagugaucagccaaagaaacgacuauaaugacggcucucaggggcccgcuaaccgggcccacgaugccgucgugcccacgaccuccgcuaaguucacaccuaagcucggaagcauucuggucggcaccugggaaaauaacgacaucgagacacagccgucuaaauuuacccccguggggcuucuggagaugaaugauuucaaccaauggucccucccuaauuacagcggagcccugacgcugaacaugggccucgcgcccgcuguuuuuccuacauuccccggcgaacagauucuguuuuuccgcuccuuuaucccucuuaaagggggacacggcaaccccgccaucgacugucugcucccgcaggaguggauucagcauuucuaucaagaaucugccccuagccagaccuccguggcucugaucagauacgucaaucccgauaccgggcgggugcuuuuugagggaaagcugcacagacagggcuucauuacaaucgccaagagcggggacggcccuauuguugugcccccgaacggauacuuccgcuuugauucuugggucaaucaguucuauucccucgcuccuaugggcaacgggaauggacggagacgcauccaauga

SEQ ID NO: 28929 - RNA, 1626 nt, Artificial Sequence
  derived and/or modified sequence opt5 from VP1__Norovirus_and/or_Norovirus-like__KX987840
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggcugaucugccggucauucagccccggcuuugcacccaugcgcgcuggccugcccccguguacggccugcucguugacccuucucugcccuccaauccgcaauggcagaacgggagagugcacgucgauggaacacuucugggcaccacgccuaucagcggcucuuggguguccuguuucgcugccgaagccgcuuaugaguaccagagcgggacaggagagguugccaccuuuacacucauugaacaagacggcucugcguacgugcccggggaucgggcugccccucugggauaucccgacuucuccggccagcuggagaucgaaguccagaccgagaccacaaagccuggggacaaacucaaggugacgaccuuugaaaugauucugggacccacaaccaaugucgaucaggccccguaccaaggccgcguguaugcuagcguuacagccgcugccacccuuaaccugguggacggcagaguccgggcggugccucgcuccaucuacggguuccaggauguuauccccgaguauaaugacggacuccuggugccccuugccccuccgauuggccccuuccugccuggggagguccuccugagauuucggacguacaugagacagaucgauucuagcgacgcugccgcugaagccauugauugcgcgcugccccaggaguucaucuccugguuugccagcaacgcuuucacagugcaaucugaagcccuccugcuucgcuaucggaauacccugaccggacagcuccuguuugaguguaagcuguacuccgaaggcuacauugcucuuagcuauccugggucuggcccccucacauucccuaccgacggauuuuucgaggugguuagcuggguccccagacuguaccagcuggccuccgugggcucucucgccacagggcgcacgcugaaacaguga

SEQ ID NO: 28930 - RNA, 1626 nt, Artificial Sequence
  derived and/or modified sequence opt5 from VP1__Norovirus_and/or_Norovirus-like__KR349276
augagaaugagcgacggcgccgcucccaaggccaacggguccgaggcgaauggacaggaucuggugccuaccgcugucgaacaagccguuccgauccagcccguggccggcgcuucucucgccgcuccugccgcggggcagauuaaccagaucgaccccuggauuuuccaaaauuuugugcagugcccucugggagaguucagcaucagcccccggaacacaccuggcgaaauucuuuuugaucuggcccucgggccgggacugaaucccuaccuugcucaccugucugccauguauacgggcugggucggcaacauggaggugcagcucguucuggcugggaaugccuucaccgcgggaaaaguggucguggcccugguuccucccuacuuuccuaagggcagccucacaaccgcucagaucacauguuucccccaugugaugugcgacguccgcacccuggaaccgauccaacuuccucugcucgaugugagacgggugcuguggcacgccacacaggaccaggaggaguccaugcgccuugucuguaugcuguauacgccccucagaaccaacucuccuggggaugaauccuuuguuguguccggacggcugcugagcaaacccgcugccgacuucaauuuuguguaccucacacccccuauugagcgcaccaucuauagaauggucgaucugccggugcuucagccccggcugugcacccaugcccgcuggccugcucccguuuacggccuccugguggacccuucucuuggguccaacccccaauggcagaauggaagaguccacguggauggcacacugcucggcaccacgccgauuagcgggucuuggguuucccuguucgcggccgaagcugccuaugaguuucagagcggaacaggcgagguggccaccuucacacugaucgaacaagacgggucugcuuacgucccuggagagcgggccgcgccccucggcuacccugauuuuuccgggcagcuggaaauugaggugcagaccgaaaccacaaagacgggagacaaacuuaaggucaccacauucgagaugauccugggccccaccacaaacguggaccaggcuccuuaucaaggccgcguuuacgccagccucaccacggccgcuucccuggaucuuguggacgggagaguccgggccgugccccgcucuauuuauggauuccaggauguuaucccggaguacaaugacggccugcucgugccucuggcuccucccaucgggcccuuucugccgggagaaguccuccugagauuccggacauauaugagacagauugauagcuccgacgccgcggccgaggcuaucgauugugcccuuccccaggaauuugugagcugguucgcuucuaacgccuuuaccgugcaauccgaggcgcugcuccugcgcuaccggaauacccugacaggccagcuucucuucgaaugcaagcuguauagcgagggguacauugcccugucuuacagcggcuccggaccucucaccuuucccacagacggcuucuuugagguugucucuugggggccuagacuguaucagcuugcuagcgugggaucccuggccacgggccgcacccucaaacaguga

SEQ ID NO: 28931 - RNA, 1626 nt, Artificial Sequence
  derived and/or modified sequence opt5 from VP1__Norovirus_and/or_Norovirus-like__KM102449
augagaaugagcgacggcgccgcucccaaggccaacggguccgaggcgaucggacaggaucuggugccuaccgcugucgaacaagccguuccgauucagcccguggccggcgcugcccucgcugccccugcggccgggcagaucaaucagauugaccccuggaucuuccaaaacuuugugcagugcccucugggagaguucucuauuagcccccggaauacaccuggcgaaauccuuuuugaucuggcucucgggccgggacugaaccccuaccuugcccaccuguccgcuauguauacgggcugggucggcaauauggaggugcagcucguucuggccgggaacgcguucaccgccggaaaaguggucguggcucugguuccucccuacuuuccuaagggcucucucacaaccgcccagaucacauguuucccccaugugaugugcgacguccgcgcucuggaaccgauucaacuuccucugcucgaugugagacgggugcuguggcacgccacccaggaccaggaggagagcaugcgccuugucuguaugcuguauacaccccucagaaccaauuccccuggggaugaaucuuuuguugugagcggacggcugcuguccaaacccgccgcugacuucaacuuuguguaccucacgcccccuaucgagcgcaccgucuauagaaugguggaucugccgguucuucagccccggcugugcacacaugcgcgcuggccugcccccguguacggccuccuggucgacccuagccuucccucuaauccgcaauggcagaacgggagagugcacguuaauggaacccugcucggcacaaccccuguguccggcagcugggucucuuguuucgcugccgaagccgcuuaugaguuucaguccgggacgggagagguggccacauucaccaugauugaacaagauggcagcgcguacguccccggggaccgggcugccccucugggauaccccgauuuuucuggccagcuggagaucgaagugcagacagagaccaccaaguccggggacaaacucaagguuacaacguucgaaaugauucugggaccuaccacaaacgccgaccaggcucccuaucaaggcaagguguacgccagccuugcugccgcggccccgcuggaucucgucgacggccgcgugagagcuguuccucgguccguguauuucuuucaggauguccugcccgaguacaaugacgggcuucuggugccccucgccccuccgcugggacccuuccugccuggcgaggugcuccugcgcuuuagaaccuauguucggcagcuugauacagcugacgccgcggcccagcccaucgauugcgcucugccucaagaguucauuucuugguuugccagcaacuccuucaccguccagagcgaagcucuccugaucagauaccgcaauacgcugacagggcagcuucucuuugaagccaaacuguauucugagggauacaucgccguguccuacagcggcucugggccccugaccuucccuaccgacggcuuuuucgaaguggucagcugggugccccggcucuuucagcuggcuuccguuggaucucuugcgacaggcagaacccugaagcaauga

SEQ ID NO: 28932 - RNA, 1626 nt, Artificial Sequence
  derived and/or modified sequence opt5 from VP1__Norovirus_and/or_Norovirus-like__KC792553
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugcuucagccccggcugugcacccaugcucgcuggccugcgcccguuuacggccuccugguggacccuucucuucccuccaauccgcaauggcagaacgggagaguccacguggauggaacacugcucggcaccacgccuguuagcggcucuuggguguccuguuucgccgcugaagccgccuaugaguuucagagcgggauuggacaagucgcuacauucaccaugaucgagcaggacggcucugccuacgugcccggggaucgggcggcuccucugggauaccccgacuauuccggccagcuggaaauugagguccagacagaaaccaccaaggccggggacaaacucaaggugacaacguuugagaugauccugggaccuaccacaaaugccgaucaagcucccuaccagggccgcgccuaugcuagccuuaccgccgcggccucccuggaccucguugauggcagagugcgggcugucccgcgcucuauuuacagcuuccaggacgugcugccugaauauaacgaugggcuucugguuccccucgcucccccucugggaccguuccugcccggcgaggugcuccugagauuucggacauacaugagacagcuugacaccgccgaugccgcggcccaaccuaucgacugcgcucugccccaggaguucgucuccugguuugccagcaauucuuucacggugcaguccgaugcucuccuggugcgcuaucggaacacacugaccgggcagcuucucuuugaagccaagcuguacagcgagggauacaucgccguuucuuauagcggcuccgggccucugaccuuccccgcugacggcauuuuugaagucgugucuugggugccuagacucuuccaacuggcgagcgucggaucccuugccacaggccgcacccugaaacaguga

SEQ ID NO: 28933 - RNA, 1626 nt, Artificial Sequence
  derived and/or modified sequence opt5 from VP1__Norovirus_and/or_Norovirus-like__AB809991
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccagggacaggacgccuucaucgauugucugcugccucaagaaugggucaaucacuuuuaccaggaggcugcccccucucaggcugacguggcccucauucgcuauguuaacccugauacaggcagaacccuguucgaagcgaaacuucaccggagcggguuuaucacagugucccauacgggagccuacccccuggucgugccgccuaacggccacuucagauuugacucuugggugaaucaguucuauagccucgcucccauggggaccggcaacggacgccggagaguuuga

SEQ ID NO: 28934 - RNA, 1626 nt, Artificial Sequence
  derived and/or modified sequence opt5 from VP1__Norovirus_and/or_Norovirus-like__AB809990
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccgcggacaggacgccuucaucgauugucugcugccucaggaaugggucaaucacuuuuaccaagaggcugcccccucucaggcugacguggcccucauuagauauguuaacccugauacaggccggacccuguucgaagcgaaacuucacagaagcggguuuaucacagugucccauacgggagccuacccccuggucgugccgccuaacggccacuuccgcuuugacucuugggugaaucaguucuauagccucgcucccauggggaccggcaacggacggagacgcguuuga

SEQ ID NO: 28935 - RNA, 1626 nt, Artificial Sequence
  derived and/or modified sequence opt5 from VP1__Norovirus_and/or_Norovirus-like__AB809977
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaacgcaccggagaggccaagaacgcuaaaggcauuuacaucagcacaaccuccgggaaguuuacaccgaagauuggaagcaucggccugcauucuaucaccgaaaauguucacccuaaccagcaauccagauucacgcccgugggggucgcccagaaugagaacacacccuuccagcagugggugcuuccucauuaugccggagcucuggcccucaauaccaaccuggcgccggcugucgcccccaccuuuccuggcgagcaacuucuguucuuucggagccgcgugcccugcguucagggccuccaggggcaggacgccuucauugauugucugcugccucaagaaugggugaaucacuuuuaccaggaggcugcccccucucaggcugacgucgcccucaucagauaugugaacccugauacaggacggacccuguucgaagcgaaacuucacagaagcggcuuuauuacaguuucccauacgggggccuacccccugguggucccgccuaacggacacuuccgcuuugacucuugggugaaucaguucuauagccucgcucccaugggcaccgggaacggccggagacgcguguga

SEQ ID NO: 28936 - RNA, 1626 nt, Artificial Sequence
  derived and/or modified sequence opt5 from VP1__Norovirus_and/or_Norovirus-like__AB809987
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucauucaggauaaugugucugaaggaacgggcgaggccaagaacgcuaaagggguuuacaucagcaccacauccggaaaguuuaccccgaagauuggcagcaucgggcugcauucuaucacagaaaaugugcacccuaaccagcaaucccgcuucacccccgucggaguggcccagaaugagaacacgcccuuccagcaguggguccuuccucauuaugccggcgcucuggcccucaauacaaaccuggcgccggcuguggcccccaccuuuccuggcgagcaacuucuguucuuuagaagccggguucccugcgugcaggggcuccgcggacaggacgccuucauugauugucugcugccucaggaaugggucaaucacuuuuaccaagaggcugcccccucucaggcugacguggcccucaucagauauguuaacccugauaccggccggacacuguucgaagcgaaacuucacagaagcggguuuauuaccgugucccauacaggagccuacccccuggucgugccgccuaacggccacuuccgcuuugacucuugggugaaucaguucuauagccucgcucccauggggacgggcaacggacggagacgcguuuga

SEQ ID NO: 28937 - RNA, 1626 nt, Artificial Sequence
  derived and/or modified sequence opt5 from VP1__Norovirus_and/or_Norovirus-like__AJ844469
augaugauggccagcaaggacgcucccuccaacauggauggcaccucuggggccggacagcuggugccugaggcgaauacagcugacccgaucccccucgaaccugucguuggcgccgccacggcugccgcuaccgccgggcaagugaacaugauugaucccuggaucaugaauaacuucgugcagagcccugagggagaauuuacaauuucccccaauaacaccccuggcgacauccuguucgaucuucagcuggggccgcaccucaaucccuuucugcagcaucuuucucaaauguacaacggaugggucggcaauaugagagugcggauucugcucgcgggcaacgccuucagcgcugggaaaaucaucauuugcuguguuccucccggauuuacagcccagaauaucuccauugcucaggccaccauguucccucacgugaucgcggacguccgcgugcuggagcccauugaaaucccgcuggaugacguuagaaacgugcucuuucauacaaaugagaacaagccuaccaugcggcugcuuugcaugcuguauacgccccuccgcgccggcggggcuucugccggaaccgauccuuucgucauugcuggcagagugcugacaugucccagccccgacuuuaauuuccuuuuucuggugccuccguccgucgagcagaaaacccggcaacucacaguucccaacaucccucugaacaaucugagcaacucucgcgugcccgccaugaucuccaagauggccauuagcucugaugcuaaucaggugguccaguuccagaacgggagaugcaccacggacggacaacuccugggcacaaccccuaucuccgcgagccagguggcccggauucgcggcaaaguguuuucuacauccagcgggaagggacuuaaucuguccgaacucgauggcucucccuaccacgcuuucgagagcccggccccuguuggguuccccgaccugggauauugugacuggcaugucuccagcuuuaaggccgaucacaacucuuccagcgacccuaucucuagacuugauauuaaacagggcgcuagcuucgcgccccaccugggguccaucgaauacaccaccucucaaaauccugacggagaucagcucggcacacugacguggaucagcucccccagcgacgauaccccgggccaugggacaauuaaccuguggaagaucccuucuuauggauccaccgugacagagagcguucaccucgccccucccauuuaucccccgggcuuuggggagacccugguguacuucaugucugacuuucccaucggacauacaaauuccaacauggcucaggucccuugcacgcuuccccaggaguucguggcccacuuugucaaugaacaagccccugugcggggcgaugcugcccugcuccacuacguugaccccgauacccaucgcaaccugggggaguucaaacuuuacccugaaggcuauauuaccugugugcccaauacaggaggcgggggaccgcagagccugccuaucaacggcgucuuuaucuucuccucuugggugagcagauacuaucagcucaagcccguugggaccgcuggaccugcccggcgccuguga

SEQ ID NO: 28938 - RNA, 1626 nt, Artificial Sequence
  derived and/or modified sequence opt5 from VP1__Norovirus_and/or_Norovirus-like__AY675555
augaagauggccagcaaagacgcucccuccaacauggauggcaccucuggggccggacagcuggugccugaggcgaauacagcugacccgaucccccucgaaccugucguuggcgccgccacggcugccgcuaccgccgggcaagugaacaugauugaucccuggaucaugaauaacuucgugcagagcccugagggagaauuuacaauuucccccaauaacaccccuggcgacauccuguucgaucuucagcuggggccgcaccucaaucccuuucugcagcaucuuucucaaauguacaacggaugggucggcaauaugagagugcggauucugcucgcgggcaacgccuucagcgcugggaagaucaucauuugcuguguuccucccggauuuacagcccagaauaucuccauugcucaggccaccauguucccucacgugaucgcggacguccgcgugcuggagcccauugaaaucccgcuggaugacguuagaaacgugcucuuucauacaaaugagaaccggccuaccaugcgccugcuuugcaugcuguauacgccccucagagccggcggggcuucugccggaaccgauccuuucgucauugcuggccgggugcugacaugucccagccccgacuuuaauuuccuuuuucuggugccuccguccgucgagcagaaaacccgccaacucacaguucccaacaucccucugaacaaucugagcaacucuuccgugcccgccaugaucaauaagauggccauuagcucugaugcuaaccaggugguccaguuccagaaugggagaugcaccacggacggacaacuccugggcacaaccccuaucuccgcgagccagguggcccggauucgcggcaaaguguuuucuacauccagcgggaagggacuuaaccuguccgaacucgauggcucucccuaccacgcuuucgagagcccggccccuguuggguuccccgaccugggacauugugacuggcacgucuccagcuuuaaggccgaucaaaauucuuccggcgacccuaucagcagacuugauauuaaacagggggcuucuuucgcgccccaccugggaagcaucgaauauaccaccucccagaacccugacggcggccagcucgggacacugacguggaucucuagccccuccgaugacaccccgggacauggcacaauuaaucuguggaagaucccuagcuacgggucuaccgugacagaguccguucaccucgccccucccauuuaucccccgggauuuggcgagacccuggugaaccuuaugagcaauuuccccaucgggcauacgaacucuaauauggcucaggucccuugcacacugccccaagaauuuguggcccacuucgucaacgagcaggccccugugcggggcgaugcugcccuccugcacuacguugaccccgauacccaucgcaaucuuggagaauuuaaacuguauccugagggcuacauuaccugugugcccaacacagggggaggcgggccgcagucccucccuaccaacggagucuucaucuuuagcuccugggugucuagauacuaucagcuggaacccguuggcacagcugggccugcccggcgccuguga

SEQ ID NO: 28939 - RNA, 1626 nt, Artificial Sequence
  derived and/or modified sequence opt5 from VP1__Norovirus_and/or_Norovirus-like__EU085479
augaagauggccagcuccgacgcuacccccucuaacgauggcgccgcggggcuggugccugagaucaauaacgaagcuauggcccucgacccggucgccggagcugccauugcugcgccccugacaggccagcaaaauaucauugauccuuggaucaugaacaauuucguucaggcccccgggggagaguuuacggugagcccuagaaacucccccggcgaagugcuucugaaucucgagcuggggccugaaauuaacccguaccuugcccaccuggcucggauguauaauggauacgccggcggcuucgagguccaggugguucucgcugggaacgccuuuaccgcgggaaaaaucaucuucgccgcuauucccccuaauuuucccaucgacaaccugucugccgcucagauuacaaugugcccucaugugaucgucgaugugcgccaacuggagcccguuaaucucccgaugccugacgugagaaacaauuucuuucacuauaaccagggcagcgauucccggcugcgccuuauugccaugcuguacacaccccucagagccaacaauucuggggacgaugucuucaccgugagcugucgggugcugacccgcccuucccccgacuuuagcuucaacuuucuuguucccccuacagucgaaucuaagaccaaaccguucacgcugcccauccucaccauuuccgagaugagcaauucuagauuuccugugcccaucgauucccugcauacaagcccuaccgaaaacaucgugguccagugccagaauggacgggugacacuggacggcgagcucauggggaccacgcaacugcuucccucucagauuugugcuuuccgcggaguucugacaagauccaccagccggacauccgaucaggcggacaccgccaccccgcgccucuucaacuauuacuggcacauccagcuggacaaucuuaacggcacaccuuaugaucccgcugaggacauuccuggcccccuggggacgccugauuuuagaggaaagguguucggcgucgccucucaacggaaucccgacagcaccacacgcgcccaugaagcuaaaguggauaccacagccgggagauuuaccccgaagcucggaucccuggagaucagcacggaaucuuccgacuucgaucagaaccagccuacacgguuuacccccguuggcauugggguggaccacgagaccgauuuccaacaguggagccugcccgacuacucuggacaguuuacacacaauaugaaccucgcgccugcugucgccccgaauuuccccggcgaacagcugcuguuuuucagaagccaacuuccuuccucuggcgggcgcagcaacggaauccucgauugccuggugccccaggaguggguccagcauuuuuaccaggaguccgccccugcucaaacccagguggcccuuguucgguaugugaaucccgacacaggcagaguccuguucgaagcuaagcuccacaaacugggguuuaugacgaucgccaagaacggagacagcccuauuaccgugcccccgaacggcuacuuccgcuucgagucuuggguuaauccuuuuuauacacuggcgcccaugggguccggcuga

SEQ ID NO: 28940 - RNA, 1626 nt, Artificial Sequence
  derived and/or modified sequence opt5 from VP1__Norovirus_and/or_Norovirus-like__AF542090
auggccagcaaggacgcucccguguccggcaccgauggggccgcgggacuggucccugagucucagcaagaaguucucccgcuggagcccguggcuggcgugcagcuugccgccccugucgcugggcagagcaacaucauugaccccuggaucagaaugaauuucgugcaggccccugcuggagaauuuacaguuucuccccggaacgccccuggcgaggugcugauugaucucgaacuggggccggagcuuaaucccuaccugaaccaccucgcgcgcauguauaauggauacgucggcggcauggagguggaaguugugcuggccgggaacgcuuucacggccggaaaaguccuguuugcugccgugccucccuccuucccuacccauggcaucacagcggcccaagcuaccaugcucccccacgugauugucgacguuagacagcuggagccggugcggcuuccucugcccgaugugcgcaaugucauguuucauuucugccaggaaaacaaggagccuagaaugcggaucguggccauccucuauacaccccugcgcgcuaauggggccggagacgauguuuuuaccgugagcuguagaguccuuacacggcccuccccugacuucgauuuuauuuuccuggugccgcccucuguugagagcaaacucaagcaguuuacccugccuaaccugcaacccaaugaaaugacgaacucccgcuucccuaccagcgugacacagcucuacaccucucccaauacaaaccuggucgugcaguuucagaauggcagaugccaacuugacgggacccugcucggaacgacaccgguccgggccgcugauaucuguuccuuccgcggcauuaccagcgcggagguggacacaaccgauucuuccagaguugccggcagccaccgggugaugguccagcugaaagaaccugacggggaggaguucucucccaccggaccuaaccccgcuccugugggcacacccgacuuucaggccgccaucuucgggacgcuuucccaacgcaacaauaccggaggcagcgggcagaacuccaauagaucucauuuugcuuauuucuacacacggaacccgaccuuugccccuggaauuggcacaguuguguucagcuuugauaccacggacuuccagaauagacagcccacaaaguuuucccccagcggcgucuaugaugacgauucuuccgaaccuuucaaccaauuuagccugccguacuacaaugggucucucggagcgguggacgcuggcaagcuggcucccccuguggcccccaacuauccuggggagcagauccuguacuuccgcggaaauauucccuuuaaaggcggguauggcggaggcgaaaucgauugccuccugccucaggaguggaucacccaccuuuacgccgaacaggcccccacccaaggggacgcugcccugcuccgguauuacaacccggauacaggaagaguucuguucgaguguaaacuucaccgcgaaggcuucauuaccaucaauuauacagggagcaacgcgcuggccgucccugugaauggaguguuucgguucgagggcugggucaacaaguuuuacacgcucacccccauguga

SEQ ID NO: 28941 - RNA, 1623 nt, Artificial Sequence
  derived and/or modified sequence opt5 from VP1__Norovirus_and/or_Norovirus-like__KM386680
augaagauggccagcaacgacgcuacccccuccaaugauggcgccgcggggcuggugccugagucuaacaaugaagcuauggcccucgagccggucguuggagccagccuggcugcccccgugacaggccagacgaacaucauugacccuuggaucagaaccaauuucgugcaagcucccaacggggaauuuacagucuccccucgcaauucucccggagagauucuugugaaccuggaacucggcccugagcugaauccguaccuugcccaccuggcgcggauguauaacggguacgccggaggcauggagguucaggugaugcucgcuggcaaugccuucaccgcugggaaaaucauuuuugccgcggugcccccuuauuuccccgucgaaaaccugagcccuccccagaucacaauguuuccgcauguuaucauugaugugagaacccuggagccuguccuccugcccaugccugacgugcgguccacacuuuuccacuuuaaucagaaggaugaacccaaaaugcgccugguggccaugcucuacacgccccugagaucuaacggaagcggcgacgaugucuucaccguuuccugccggauccuuacccgcccuagcccggaguuugacuucacauaucuggugcccccuaccguggagucuaagacaaaacccuuuacccucccuguccugacgcugggggaacucuccaauagcagauucccccugucuauugaugagauggugacauccccgaacgaaagcaucguugugcaaccucagaacggacgggucacccuugacggcgagcugcucgggacaacccagcugcaggcuuguaauauuugcucuauccgcggaaaggugaccggccaaguucccaacgaacagcauauguggaaucuugagauuacaaaccugaauggcacgcaguuugauccuaccgacgaugugcccgccccucucgggguccccgacuucgcuggagagguguucggcguccugucccagagaaaccgcggggaaagcaauccggccaaccgggcccacgacgcugugguugcgacauacuccgauaaguauaccccuaaacugggacucgugcaaaucggcacauggaauaccaacgacgucgagaaucagcccacgaaguuuacacccaucgggcugaacgaaguggccaauggacauagauucgagcaguggacccuuccucgguacucuggcgcucugacccucaacaugaaucuggccccggccguugcuccccuuuuuccuggcgaacgccuccuguucuuuagaagcuacgugccccugaaagggggauucggcaacccugccauugauugucuggucccccaagagugggugcagcacuuuuaucaggaguccgcgccuagccucggggacguggcucugguucgguacgucaaccccgauacaggaagagugcuuuucgaagccaagcugcacaaaggcggguuucucaccgugucuuccacaagcacgggcccggucgugguuccugccaauggauauuuccgcuuugacucuugggugaaccaguucuacagccuggcucccaugggcaccgggaauggacggagacgcuuucaauga

SEQ ID NO: 28942 - RNA, 1623 nt, Artificial Sequence
  derived and/or modified sequence opt5 from VP1__Norovirus_and/or_Norovirus-like__AF397156
augaagauggccagcaacgacgcuacccccuccaaugauggcgccgcggggcuggugccugagucuaacaaugaagcuauggcccucgagccggucguuggagccagccuggcugcccccgugacaggccagacgaacaucauugacccuuggaucagaaccaauuucgugcaagcucccaacggggaauuuacagucuccccucgcaauucucccggagagauucuugugaaccuggaacucggcccugagcugaauccguaccuugcccaccuggcgcggauguauaacggguacgccggaggcauggagguucaggugaugcucgcuggcaaugccuucaccgcugggaaaaucauuuuugccgcggugcccccuuauuuccccgucgaaaaccugagcccuucccagaucacaauguuuccccauguuaucauugaugugagaacccuggagccgguccuccugccuaugcccgacgugcggucuacacuuuuccacuuuaaucagaaggaugaaccuaaaaugcgccugguggccaugcucuacacgccccugagaagcaacggauccggcgacgaugucuucaccguuagcugccggauccuuacccgccccucuccugaguuugacuucacauaucuggugccgcccaccguggaguccaagacaaaaccuuuuacccuccccguccugacgcugggggaacucagcaauucuagauucccucuguccauugaugagauggugacaagccccaacgaaucuaucguugugcaaccgcagaacggacgggucacccuugacggcgagcugcucgggacaacccagcugcaggcuuguaauauuugcuccauccgcggaaaggugaccggccaaguuccuaacgaacagcauauguggaaucuugagauuacaaaccugaauggcacgcaguuugaucccaccgacgaugugccugcuccccucggggucccugacuucgccggagagguguucggcguccugagccagagaaaccgcggggaauccaaucccgccaaccgggcccacgacgcugugguugcgacauacucugauaaguauaccccgaaacugggacucgugcaaaucggcacauggaauaccaacgacgucgagaaucagccuacgaaguuuacacccaucgggcugaacgaaguggccaauggacauagauucgagcaguggacccuuccccgguacagcggcgcucugacccucaacaugaaucuggccccugccguugcuccgcuuuuucccggcgaacgccuccuguucuuuagauccuacgugccucugaaagggggauucggcaaccccgccauugauugucuggucccucaagagugggugcagcacuuuuaucaggagagcgcgcccucucucggggacguggcucugguucgguacgucaacccugauacaggaagagugcuuuucgaagccaagcugcacaaaggcggguuucucaccguguccagcacaucuacgggccccgucgugguuccggccaauggauauuuccgcuuugacccuuggggcaaccaguucuacagccuggcucccauggggaccggaaauggccggagacgcuuucaauga

SEQ ID NO: 28943 - RNA, 1623 nt, Artificial Sequence
  derived and/or modified sequence opt5 from VP1__Norovirus_and/or_Norovirus-like__AF414422
augaagauggccagcaacgacgcuacccccuccaaugauggcgccgcggggcuggugccugagucuaacaaugaagcuauggcccucgagccggucguuggagccagccuggcugcccccgugacaggccagacgaacaucauugacccuuggaucagaaccaauuucgugcaagcucccaacggggaauuuacagucuccccucgcaauucucccggagagauucuugugaaccuggaacucggcccugagcugaauccguaccuugcccaccuggcgcggauguauaacggguacgccggaggcauggagguucaggugaugcucgcuggcaaugccuucaccgcugggaaaaucauuuuugccgcggugcccccuuauuuccccgucgaaaaccugagcccuucccagaucacaauguuuccccauguuaucauugaugugagaacccuggagccgguccuccugccuaugcccgacgugcggucuacacuuuuccacuuuaaucagaaggaugaaccuaaaaugcgccugguggccaugcucuacacgccccugagaagcaacggauccggcgacgaugucuucaccguuagcugccggauccuuacccgccccucuccugaguuugacuucacauaucuggugccgcccaccguggaguccaagacaaaaccuuuuacccuccccguccugacgcugggggaacucagcaauucuagauucccucuguccauugaugagauggugacaagccccaacgaaucuaucguugugcaaccgcagaacggacgggucacccuugacggcgagcugcucgggacaacccagccucaggcuuguaauauuugcuccauccgcggaaaggugaccggccaaguucccaacgaacagcauacauggaaucuggagauuacgaaccuuaauggcacccaguuugauccuacagacgaugugcccgccccucuggggguccccgacuucgcuggagagguguucggcguccucagccagagaaaccgcggggaauccaauccggccaaccgggcccacgacgcugugguugcgaccuacucugauaaguauacaccuaaacugggacuggugcaaaucggcaccuggaauacgaacgacgucgagaaucagcccacaaaguuuacccccaucgggcucaacgaaguggccaauggacauagauucgagcaguggacccugccucgguacagcggcgcucuuacacugaacaugaaucucgccccggccguugcuccccuguuuccuggcgaacgccuucuguucuuuagauccuacgugccccucaaagggggauucggcaacccugccauugauugucuggucccccaagagugggugcagcacuuuuaucaggagagcgcgccuucucugggggacguggcucucguucgguacgucaaccccgauaccggaagagugcuguucgaagccaaacuucacaagggcggguuucugacaguguccagcacgucuaccggcccggucgugguuccugccaauggauauuucggcuuugacagcugggugaaccaguucuacucccucgcucccauggggacaggaaauggccgccggagauuucaauga

SEQ ID NO: 28944 - RNA, 1623 nt, Artificial Sequence
  derived and/or modified sequence opt5 from VP1__Norovirus_and/or_Norovirus-like__AF414423
augaagauggccagcaacgacgcuacccccuccaaugauggcgccgcggggcuggugccugagucuaacaaugaagcuauggcccucgagccggucguuggagccagccuggcugcccccgugacaggccagacgaacaucauugacccuuggaucagaaccaauuucgugcaagcucccaacggggaauuuacagucuccccucgcaauucucccggagagauucuugugaaccuggaaagcggcccugagcucaauccguaccuggcccaccuugcgcggauguauaacggguacgccggaggcauggagguucaggugaugcuggcuggcaaugccuucaccgcugggaaaaucauuuuugccgcggugcccccuuauuuccccguggaaaaccucuccccuucucagaucacaauguuuccccauguuaucauugaugugagaacccuggagccgguccugcucccuaugcccgacgugcggagcacaccuuuccacuuuaaucagaaggaugaacccaaaaugcgccugguggccaugcuuuacacgccccugagauccaacggaagcggcgacgaugucuucaccguuucuugccggauccucacccgcccuuccccggaguuugacuucacauaucuggugcccccuaccguggagagcaagacaaaacccuuuacccuuccuguccugacgcucggggaacugucuaauuccagauucccccugagcauugaugagauggugacaucuccgaacgaauccaucguugugcaaccucagaacggacgggucacccucgacggcgggcugcuuggaacaacccagcugcaggcuuguaauauuugcagcauccgcggcaaggugaccggccaaguucccuccgagcagcauauguggaaccucgaaauuacaaaucugaacgggacgcaguuugauccuaccgacgaugugcccgccccucuuggaguccccgacuucgcuggcgagguguucgggguccugucucagagaaaucggggagagagcaacuccgccaaucgcgcccacgacgcugugguugcgacauacagcgauaaguauaccccgaaacucggccuggugcaaaucgggacauggaacaccaaugacgucgaaaaccagccuacgaaguuuacacccaucggacugaauggcguggccaacggccauagauucgagcaguggacccucccccgguacucuggggcucugacccuuaauaugaaccuggccccugccguugcuccgcucuuucccggagaacgccugcuuuucuuuagauccuacgugccucugaaaggcggguucggaaaucccgccauugauugucucgucccucaagagugggugcagcacuuuuaucaggaaagcgcgcccucucugggcgacguggcucugguucgguacgucaacccugauacagggagaguccucuucgaggccaagcugcacaaaggcggauuucuuaccgugagcuccacaucuacgggccccgucgugguuccggccaacggguauuuccgcuuugacagcugggugaaucaguucuacucccuggcuccuaugggaaccggcaacgggcggagacgcuuucaauga

SEQ ID NO: 28945 - RNA, 1623 nt, Artificial Sequence
  derived and/or modified sequence opt5 from VP1__Norovirus_and/or_Norovirus-like__GQ856476
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagagauucugcucaaucuggaacuuggcccugagcugaacccguaccucgcgcaccugucucgcauguauaauggguacgccggaggcguggagguucaggugcugcucgcuggcaacgccuucaccgcugggaaacuggucuuugccgcgauucccccucauuuccccguggauaaucuuagcccuggacagaucacaauguuuccccacguuaucaucgacgugagaacccuggaaccgguccuccugccucuucccgaugugcggaacaauuucuuucauuauaaccagcaauccgaccagcgcaugagacugguggccaugcucuacacaccucugcggucuaacggcagcggggaugacgucuucaccguuuccugccgcgugcugacaagacccagccccgauuuugacuucaauuaucucgugccuccgaccgucgagucuaagacgaaacccuuuuccgugccuguucugacccuuaacgaacugacaaauagccgguuccccgugccuauugaugcuauguacaccucucccaacgacuccaucgucgugcagccgcagaauggacgcgccacaauugauggcgagcuccuggggaccacgcaacuuaucccuagcggaauuuguucuuuuagaggcaagaucacaacccaccuggcugacgaccggcaucucuggaacauucagguuuccaaucugaacggcacacccuucgauccuaccgacgaugugcccgccccucuggggaugcccgacuucagcggacagaucuuuggcgucgugucccagcgcgauaccgggacaaauccggccaacagagcucacgacgcgguccucgccacguauucugcuaaauacaccccuaagcugggaagcgugcaaaucggcacaugggauaccgaggaccuucuggaacggcagcccguuaaguucacacccguggggcucaaugagauuggacaggauaaacacuuugaccaauggguccugccuaacuacuccggcgcccuuggccugaauaugcaucucgccccggcugugagcccccuguucccuggggaacgccugcucuuuuucagaucuuauaucccccugaagggaggccacggggauccuuuuauugacugccuuguuccccaggaguggauccagcauuucuaccaggaauccgccccugcgcaaagcucuguggcucugcuccgguaugucaaccccgacaccggaagaacgcuguuugaggccaaacugcacaagggcggguucauuacagugagcuccaccgagaaucgcccggugaucguuccucccaacggcuacuuucgguucgauucuugggucaaccaguuuuauagccuugccccuaugggaaccggcaaugggagacgccggaugcaguga

SEQ ID NO: 28946 - RNA, 1623 nt, Artificial Sequence
  derived and/or modified sequence opt5 from VP1__Norovirus_and/or_Norovirus-like__AJ277607
augaagauggccagcaacgacgcuacccccuccaaugauggcgccgcggggcuggugccugagucuaacaaugaagcuauggcccucgagccggucguuggagccagccuggcugcccccgugacaggccagacgaacaucauugacccuuggaucagaaccaauuucgugcaagcucccaacggggaauuuacagucuccccuaaaaauucucccggagagauucuugugaaccuggaacucggcccugagcugaauccguaccuugcccaccuggcgcggauguauaacggguacgccggaggcauggagguucaggugaugcucgcuggcaaugccuucaccgcugggaagaucauuuuugccgcggugcccccuuauuuccccgucgaaaaccugagcccuucccagaucacaauguuuccccauguuaucauugaugugcgcacccuggagccgguccuccugccuaugcccgacgugagaucuacacuuuuccacuuuaaucagaaagaugaaccuaagaugcggcugguggccaugcucuacacgccccugcgcagcaacggauccggcgacgaugucuucaccguuagcugcagaauccuuacccggcccucuccugaguuugacuucacauaucuggugccgcccaccguggaguccaaaacaaagccuuuuacccuccccguccugacgcugggggaacucagcaauucucgcuucccucuguccauugaugagauggugacaagccccaacgaaucuaucguugugcaaccgcagaacggaagagucacccuuuacggcgagcugcucgggacagcucagcugcaggccuguaauauuugcuccauccggggaaaggugaccggccaauuuccuaacgaacagaauauguggaaccuugagauuaccaaucugaacggcacacaguucgaccucacggaugacguucccgcuccucugggggugcccgauuucgccggagaggucuuuggcgugcugagccagcgcaauagaggggaauccaacccugccaaucgggcucaugacgcggucguggccaccuauucugacaaauacacacccaagcucggacugguucaaaucggcaccuggaacacaaaugauguggagaaccagccgaccaaauucacgccuaucgggcuuaaugaagucgcuaacggacaccgcuuugagcaguggacacugcccagauacagcggcgcccucacccugaauaugaaccuugcccccgcuguggccccucuguucccgggcgaacggcuccuguuuuuccgcuccuauguuccccugaaagggggauuuggcaacccugcgauugacugucucgugccccaagaguggguccagcauuucuaccaggagagcgcuccuucucugggggauguggcccuugugagauauguuaaucccgacaccggacggguccuguuugaagccaagcuccacaagggcggguuccugacaguguccagcaccucuacaggcccuguggucgugcccgcuaacggauacuuuagauucgauagcuggguuaaucaguuuuauucccuggccccgaugggcacggggaacggacgccggagauuccaauga

SEQ ID NO: 28947 - RNA, 1623 nt, Artificial Sequence
  derived and/or modified sequence opt5 from VP1__Norovirus_and/or_Norovirus-like__AY772730
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagagauucugcucaaucuggaacuuggcccugagcugaacccguaccucgcgcaccuggcccgcauguauaauggguacgcuggaggcguggagguucaggugcugcucgccggcucugcuuucaccgccgggaaacuggucuuugcggccauucccccucauuuccccguggauaaccuuagcccuggacagaucacaauguuuccccacguuaucaucgacgugagaacccuggaaccgguccuccugccucuucccgaugugcggaauaacuucuuucauuauaaucagcaauccgaccagcgcaugagacugguggcuaugcucuacacaccucugcggucuaacggcagcggggaugacgucuucaccguuuccugccgcgugcugacaagacccagccccgauuuugacuucaacuaucucgugccuccgaccgucgagucuaagacgaaacccuuuuccgugccuguucugacccuuaaugaacugacaaacagccgguuccccgugccuauugaugccauguacaccucucccaaugacuccaucgucgugcagccgcagaacggacgcgcuacaauugauggcgagcuccuggggaccacgcaacuuaucccuagcggaauuuguucuuuuagaggcaagaucacaacccaccuguccgacgaccggcaucucuggaauauucagguuagcaaccugaauggcacacccuucgauccuaccgacgaugugcccgccccucuggggaugcccgacuucuccggacagaucuuuggcgucgugucucagcgcgauaccgggacaaacccggccaauagagcucacgacgcggcccucgcuacguauagcgccaaauacaccccuaagcugggauccguccaaaucggcgccugggauacagaggaccuucuggaacggcagcccgugaaguucagccccguugggcucucugagauuggacaggauaaacacuuugaccaaugggugcugccuaacuacuccggcgcucuuggccugaauguccaucucgccccggcggugagcccccuguucccuggggaacgccugcucuuuuucagaucuuauaucccccugaagggaggccacggggauccuuuuauugacugccuuguuccccaggaguggauccagcauuucuaccaggaaagcgcuccugcccaauccucuguggcccugcuccgguaugucaaccccgacaccggaagaacacuguuugaggcuaaacugcacaaggagggcuucauuaccgugagcuccacggaaaaucgcccggugaucguuccucccaacggguacuuucgguucgauagcugggucaaucaguuuuauucucuugccccuaugggcacaggaaacggcagacgccggaugcaguga

SEQ ID NO: 28948 - RNA, 1623 nt, Artificial Sequence
  derived and/or modified sequence opt5 from VP1__Norovirus_and/or_Norovirus-like__KT315718
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauaauaaccagcccaacagccgcaugagacuugucgcuaugcuguacacaccccuccgguccaauggcucuggggacgauguguucaccgugagcugccgcguccugacgagaccuaccccggacuuugaguucacauaucugguucccccuuccguggaaagcaagaccaaacccuuuucucucccuauucugacacuuuccgagcugaccaacagccgguuccccgugccgaucgauucucucuuuacggcccaaaauaacguccuucaggugcagugucagaauggacgcugcacacuugacggcgagcugcaagggaccacacagcuccugccuuccggaauuugugcuuucagaggccggguuaccgcccagaucaaccagcgcgauagauggcauaugcaacugcagaaucucaacggcaccacauacgaccccacggaugacgugccugcuccccuggggaccccugacuucaagggagucguguuuggcaugguuagccagcggaauguggggaacgaugcccccgacucuacacgcgcgcaacaggccuccgucagcaccuauuccccgcaguucgugccuaaacuuggaucugucaaucugagaauuagcaacaaugaugacuuucaguuccaacccacaaaguuuacccccgugggcguuaacgaugacgaugacgggcacccuuuccggcagugggaacucccgaauuacuccggagagcugacgcuuaacaugaaccuggcucccccuguggcccccaauuuuccuggcgaacagcuccuguucuuucgcagcuucguccccugcucuggcggguacaaccagggaaucaucgauugucugauuccucaagaguggauccagcauuuuuaucaggaauccgcccccagccagucugacguggcucucauuagauacguuaauccggauacaggccggacccuguucgaggccaagcugcacagaagcggguauaucaccguggcgcacuccggagacuacccucuggucgugcccgcuaacggccauuuucgcuucgacucuugggugaaucaauucuauagccucgccccuauggggacaggcaacggacggagacgcgcccaguga

SEQ ID NO: 28949 - RNA, 1623 nt, Artificial Sequence
  derived and/or modified sequence opt5 from VP1__Norovirus_and/or_Norovirus-like__KT315708
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucaucgauugucugauuccucaagaguggauccagcauuuuuaucaggaauccgcccccagccagucugacguggcucucauuagauacguuaauccggauacagggcggacccuguucgaggccaagcugcacagaagcggauauaucaccguggcgcacuccggcgacuacccucuggucgugcccgcuaacggguauuuucgcuucgacucuugggugaaucaauucuacagccucgccccuaugggcacaggaaacggccggagacgcgcccaguga

SEQ ID NO: 28950 - RNA, 1623 nt, Artificial Sequence
  derived and/or modified sequence opt5 from VP1__Norovirus_and/or_Norovirus-like__KT315697
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucaucgauugucugauuccucaagaguggauccagcauuuuuaucaggaauccgcccccagccagucugacguggcucucauuagauacguuaauccggauacagggcgggcccuguucgaggcgaagcugcacagaagcggauauaucaccguggcucacuccggcgacuacccucuggucgugcccgccaacgggcauuuucgcuucgacucuugggugaaucaauucuauagccucgccccuaugggcaccggaaacggccggagacgcgcucaguga

SEQ ID NO: 28951 - RNA, 1623 nt, Artificial Sequence
  derived and/or modified sequence opt5 from VP1__Norovirus_and/or_Norovirus-like__KT315689
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucaucgauugucugauuccucaagaguggauccagcauuuuuaucaggaauccgcccccagccagucugacguggcucucauuagauacguuaauccggauacagggcggacccuguucgaggccaagcugcacagaagcggauauaucaccgugucccacucuggcgacuacccucuggucgugcccgcgaacgggcauuuucgcuucgacagcugggugaaucaauucuauucccucgcuccuaugggcacaggaaacggccggagacgcgcccaguga

SEQ ID NO: 28952 - RNA, 1623 nt, Artificial Sequence
  derived and/or modified sequence opt5 from VP1__Norovirus_and/or_Norovirus-like__KX216805
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuaccggaauuugugcuuucagaggccggguuaccgcccagaucaaucagcgcgauagauggcauaugcaacugcagaaccucaauggcacaacguacgaccccaccgaugacgugccugcuccccuggggacaccugacuucaagggagucguguuuggcaugguuagccagcggaacguggggaaugaugcccccggaucuacccgcgcgcaacaggccugggucuccacauauagcccgcaguucgugccuaaacuuggcuccgucaaccugagaauuucugacaaugaugacuuucaguuccaacccaccaaguuuacgcccguggggguuaacgaugacgaugacggacacccuuuccggcagugggaacucccgaauuacagcggcgagcugacacuuaacaugaaucuggcucccccuguggcccccaacuuuccuggcgaacagcuccuguucuuuagauccuucguccccugcagcgggggauacaaccagggcaucaucgauugucugauuccucaagaguggauccagcauuuuuaucaggaaucugcccccucccagagcgacguggcucucauucgcuacguuaauccggauaccgggcggacccuguucgaggccaagcugcacagaucuggauauaucacaguggcgcacagcggcgacuacccucuggucgugcccgcuaacggguauuuucgcuucgacuccugggugaaucaauucuacucucucgccccuaugggcaccggaaacggccggagacgcgcccaguga

SEQ ID NO: 28953 - RNA, 1623 nt, Artificial Sequence
  derived and/or modified sequence opt5 from VP1__Norovirus_and/or_Norovirus-like__KU557859
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcgugaucgauugucugaucccucaagaguggauucagcauuuuuaucaggaauccgcccccagccagucugacguugcucucaucagauacgugaauccggauacagggcggacccuguucgaggccaagcugcacagaagcggauauauuaccgucgcgcacuccggcgacuacccucugguggugcccgcuaacgggcauuuucgcuucgacucuuggguuaaucaauucuauagccucgccccuaugggcacaggaaacggccggagacgcgcccaguga

SEQ ID NO: 28954 - RNA, 1623 nt, Artificial Sequence
  derived and/or modified sequence opt5 from VP1__Norovirus_and/or_Norovirus-like__KU557828
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccgacuccacacgcgcgcaacaggccugggucagcaccuauuccccgcaguucgugccuaaacuuggaucugucaaccugagaauuagcgauaaugacgauuuucaguuccaacccacaaaguuuacccccgugggcguuaacgacgaugacgaugggcacccuuuccggcagugggaacucccgaauuacuccggagagcugacgcuuaacaugaaucuggcucccccuguggcccccaacuuuccuggcgaacagcuccuguucuuucgcagcuucguccccugcucuggcggguacaaccagggaaucaucgacugucugauuccucaagaguggauccagcauuuuuaucaggaauccgcccccagccagucugauguggcucucauuagauacguuaauccggacacaggccggacccuguucgaggccaagcugcacagaagcggguauaucaccguggcgcacuccggagacuacccucuggucgugcccgcuaacggccauuuucgcuucgauucuugggugaaucaauucuauagccucgccccuauggggacaggcaacggacggagacgcgcccaguga

SEQ ID NO: 28955 - RNA, 1623 nt, Artificial Sequence
  derived and/or modified sequence opt5 from VP1__Norovirus_and/or_Norovirus-like__KT315692
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugucccucgaacuggggccggaucuuaaucccuaccuggcgcaccucucucgcauguauaacggauacgccggcggcgucgaggugcagguucugcuggcugggaaugccuucacagcuggaaaaauucucuuugccgcggugccucccaacuucccugucgaguuucugagccccgcccagaucaccaugcuuccgcaucugaucguggacguuagaacacucgaaccuauuaugaucccccugccugaugugcggaauaccuucuuucacuauuccaaccagcccaauucucgcaugagacuugucgcuaugcuguacacaccccuccggagcaacggcuccggggacgauguguucaccgugagcugccgcguccugacgagaccuaccccggacuuugaguucacauaucugguucccccuucuguggaauccaagaccaaacccuuuagccucccuauucugacacuuucugagcugaccaacucccgguuccccgugccgaucgauagccucuuuacggcccaaaauaacguccuucaggugcagugucagaauggacgcugcacacuugacggcgagcugcaagggaccacacagcuccugccuucuggaauuugugcuuucagaggccggguuaccgcccagaucaaccagcgcgauagauggcauaugcaacugcagaaucucaacggcaccacauacgaccccacggaugacgugccugcuccccuggggaccccugacuucaagggagucguguuuggcaugguuucccagcggaauguggggaacgaugcccccggaagcacacgcgcgcaacaggccugggucuccaccuauucuccgcaguucgugccuaaacuuggcagcgucaaucugagaauuuccgacaacgaugacuuucaguuccaacccacaaaguuuacccccguggggguuaaugaugacgaugacggacacccuuuccggcagugggaacucccgaacuacagcggcgagcugacgcuuaauaugaaccuggcucccccuguggcccccaauuuuccuggcgaacagcuccuguucuuuagaucuuucguccccugcuccgggggauacaaccagggcaucaucgauugucugauuccucaagaguggauccagcauuuuuaucaggaaagcgcccccucucagagcgacguggcucucauucgcuacguuaacccggauacagggcggacccuguucgaggccaagcugcacagauccggauauaucaccguggcgcacucuggcgacuacccucuggucgugcccgcuaaugggcauuuucgcuucgacagcugggugaaccaauucuauucccucgccccuaugggcacaggaaauggccggagacgcgcccaguga

SEQ ID NO: 28956 - RNA, 1623 nt, Artificial Sequence
  derived and/or modified sequence opt5 from VP1__Norovirus_and/or_Norovirus-like__KX168437
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagguccuucugaaucucgaacuggggccggaucuuaaccccuaccuggcgcaccucucccgcauguauaauggauacgccggcggcguggagguucaggugcugcuggcugggaacgccuucacagcuggaaagauccucuuugccgcggucccucccaauuucccuguggaguuucugucucccgcccagauuaccaugcuuccgcaucugaucguugacgugagaacacucgaaccuaucaugauuccccugccugauguccggaacaccuucuuucacuauagcaaucagcccaacucccgcaugagacuuguggcuaugcuguacacaccccuccggucuaacggcagcggggacgauguguucaccgucuccugccgcguucugacgagaccuaccccggacuuugaguucacauaucuggugcccccuagcguggaaucuaagaccaaacccuuuucccucccuauccugacacuuagcgagcugaccaauucucgguuccccgucccgauugauucccucuuuacggcccaaaacaaugugcugcagguucagugucagaacggacgcugcacacuugacggcgagcugcaagggaccacacagcuccugccuagcggaaucugugcuuucagaggccgggugaccgcccagauuaaucagcgcgauagauggcauaugcaacugcagaaccucaauggcaccacauacgaccccacggaugacgucccugcuccccuggggaccccugacuucaagggagugguuuuuggcauggugucucagcggaacgucgggaaugaugcccccggauccacacgcgcgcaacaggccugggugagcaccuauuccccgcaguucgucccuaaacuuggcucugugaaccugagaaucagcgacaaugaugacuuucaguuccaacccacaaaguuuacccccguuggggugaacgaugacgaugacggacacccuuuccggcagugggaacucccgaauuacuccggcgagcugacgcuuaacaugaaucuggcucccccugucgcccccaacuuuccuggcgaacagcuccuguucuuucgcagcuucgugcccugcucugggggauacaaccagggcauuaucgauugucugaucccucaagaguggauucagcauuuuuaucaggaauccgcccccagccagucugacguugcucucaucagauacgugaauccggauacagggcggacccuguucgaggccaaacuucacagaagcggauauauuaccgucgcgcacuccggcgacuacccucugguggugcccgcuaacgggcauuuucgcuucgacucuuggguuaaucaauucuauagccucgccccuaugggcacaggaaacggccggagacgcgcccaguga

SEQ ID NO: 28957 - RNA, 1623 nt, Artificial Sequence
  derived and/or modified sequence opt5 from VP1__Norovirus_and/or_Norovirus-like__KX168440
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacgugggguccgaugcccccggaagcacacgcgcgcaacaggccugggucuccaccuauucuccgcaguucgugccuaaacuuggcagcgucaaucugagaauuuccgacaacgaugacuuucaguuccaacccacaaaguuuacccccguggggguuaaugaugacgaugacggacacccuuuccggcagugggaacucccgaacuacagcggcgagcugacgcuuaauaugaaccuggcucccccuguggcccccaauuuuccuggcgaacagcuccuguucuuuagaucuuucguccccugcuccgggggauacaaccagggcaucaucgauugucugauuccucaagagugggugcagcauuuuuaucaggaaagcgcccccucucagagcgacguugcucucauccgcuacgugaacccggauacagggcggacccuguucgaggccaagcugcacagauccggauauauuaccgucgcgcacucuggcgacuacccucugguggugcccgcuaaugggcauuuucgcuucgacagcuggguuaaccaauucuauucccucgccccuaugggcacaggaaauggccggagacgcgcccaguga

SEQ ID NO: 28958 - RNA, 1623 nt, Artificial Sequence
  derived and/or modified sequence opt5 from VP1__Norovirus_and/or_Norovirus-like__KX216793
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuccaggugcagugucagaacggacgcugcacacuugacggcgagcugcaagggaccacacagcucguuccuagcggaauuugugcuuucagaggccgggugaccgcccagaucaaucagcgcgauagauggcauaugcaacugcagaaccugaauggcaccacauacgaccccacggaugacgucccugcuccccucgggaccccugacuucaagggagugguuuuuggcauggugucucagcggaacgucgggaaugaugcccccggauccacacgcgcgcaacaggccugggugagcaccuauuccccgcaguucgucccuaaacugggcucugugaaccuuagaauuagcgacaaugaugacuuucaguuccaacccacaaaguuuacccccguuggggugaacgaugacgaugacggacacccuuuccggcagugggaacugccgaauuacuccggcgagcucacgcugaacaugaaucuugcucccccugucgcccccaacuuuccuggcgaacagcugcuguucuuucgcagcuucgugcccugcucugggggauacaaccagggcaucaucgauugucugauuccucaagaguggauccagcauuuuuaucaggaauccgcccccagccagucugacguugcucugauuagauacgugaauccggauacagggcggacccucuucgaggccaagcugcacagaagcggauauaucaccgucgcgcacuccggcgacuacccucuuguggugcccgcuaacgggcauuuucgcuucgacucuuggguuaaucaauucuauagccuggccccuaugggcacaggaaacggccggagacgcgcccaguga

SEQ ID NO: 28959 - RNA, 1623 nt, Artificial Sequence
  derived and/or modified sequence opt5 from VP1__Norovirus_and/or_Norovirus-like__KU557881
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuggacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuuagaagccugguccccugcucugggggauacaaccagggcaucaucgauugucucauuccucaagaguggauccagcauuucuaucaggaauccgcccccagccagucugacguggcucugauucgcuacguuaauccggauacagggcggacccuuuuugaggccaagcugcacagaagcggauauaucaccguggcgcacuccggcgacuacccucucgucgugcccgcuaacgggcauuuccgcuuugacucuugggugaaucaauucuauagccuggccccuaugggcacaggaaacggccggagacgcgcccaguga

SEQ ID NO: 28960 - RNA, 1623 nt, Artificial Sequence
  derived and/or modified sequence opt5 from VP1__Norovirus_and/or_Norovirus-like__KY424350
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacaaccgcaugagacuugucgcuaugcuguacacaccccuccgguccaauggcucuggggacgauguguucaccgugagcugccgcguccugacgagaccuaccccggacuuugaguucacauaucugguucccccuuccguggaaagcaagaccaaacccuuuucucucccuauucugacacuuuccgagcugaccaacagccgguuccccgugccgaucgauucucucuuuacggcccaaaauaacguccuucaggugcagugucagaauggacgcugcacacuugacggcgagcugcaagggaccacacagcuccugccuuccggaauuugugcuuucagaggccggguuaccgcccagaucaaccagcgcgauagauggcauaugcaacugcagaaucucaacggcaccacauacgaccccacggaugacgugccugcuccccuggggaccccugacuucaagggagucguguuuggcaugguuagccagcggaauguggggaacgaugcccccggaucuacacgcgcgcaacaggccugggucuccaccuauagcccgcaguucgugccuaaacuuggcuccauuaaucugagaaucucugacaacgaugacuuucaguuccaacccacaaaguuuacccccgucggggugaaugaugacgaugacggacacccuuuccggcagugggaacucccgaacuacagcggcgagcugacgcuuaauaugaaccuggcucccccuguugcccccaacuuuccuggcgaacagcuccuguucuuuagauccuucgugcccugcagcgggggauacaaucagggcaucauugauugucugaucccucaagaguggauucagcauuuuuaucaggaaucugcccccucccagagcgacgucgcucucauccgcuacgugaacccggauacagggcggacccuguucgaggccaagcugcacagaucuggauauauuaccguugcgcacagcggcgacuacccucuggugguccccgcuaaugggcauuuucgcuucgacuccugggugaaccaauucuauucucucgccccuaugggcacaggaaauggccggagacgcgcccaguga

SEQ ID NO: 28961 - RNA, 1623 nt, Artificial Sequence
  derived and/or modified sequence opt5 from VP1__Norovirus_and/or_Norovirus-like__KU557884
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcgccaccuacgaccccacagaugacgugccugcuccccuggggacgccugacuucaagggagucguguuuggcaugguuucucagcggaacgugggguccgaugcgcccggaagcacccgcgcccaacaggcuugggucuccacauauucuccgcaguucgugccuaaacuuggcagcgucaaucugagaauuuccgacaacgaugacuuucaguuccaacccaccaaguuuacacccguggggguuaaugaugacgaugacggacacccuuuccggcagugggaacucccgaacuacagcggcgagcugacccuuaauaugaaccuggcucccccuguggcccccaauuuuccuggcgaacagcuccuguucuuuagaucuuucguccccugcuccgggggauacaaccagggcaucaucgauugucugauuccucaagaguggauccagcauuuuuaucaggaaagcgcccccucucagagcgacguggcccucauucgcuacguuaacccggauacggggcggacacuguucgaggcgaagcugcacagauccggauauaucaccguggcucacucuggcgacuacccucuggucgugcccgccaaugggcauuuucgcuucgacagcugggugaaccaauucuauucccucgccccuaugggcaccggaaauggccggagacgcgcucaguga

SEQ ID NO: 28962 - RNA, 1623 nt, Artificial Sequence
  derived and/or modified sequence opt5 from VP1__Norovirus_and/or_Norovirus-like__KU561253
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacacguuccggcagugggaacucccuaauuacuccggcgagcugacacuuaacaugaaucuggcuccgcccguggccccuaacuuucccggcgaacagcuccuguucuuucgcagcuucgucccuugcucugggggauacaaccagggcaucaucgauugucugauuccccaagaguggauccagcauuuuuaucaggaauccgccccuagccagucugacguggcucucauuagauacguuaaucccgauaccgggcggacccuguucgaggccaagcugcacagaagcggauauaucacaguggcgcacuccggcgacuacccgcuggucgugccugcuaacgggcauuuucgcuucgacucuugggugaaucaauucuauagccucgcccccaugggcaccggaaacggccggagacgcgcccaguga

SEQ ID NO: 28963 - RNA, 1623 nt, Artificial Sequence
  derived and/or modified sequence opt5 from VP1__Norovirus_and/or_Norovirus-like__KP902588
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacgugggguccgaugcccccggaagcacacgcgcgcaacaggccugggucuccaccuauucuccgcaguucgugccuaaacuuggcagcgucaaucugagaauuuccgacaacgaugacuuucaguuccaacccacaaaguuuacccccguggggguuaaugaugacgaugacggacacccuuuccggcagugggaacucccgaacuacagcggcgagcugacgcuuaauaugaaccuggcucccccuguggcccccaauuuuccuggcgaacagcuccuguucuuuagaucuuccguccccugcagcgggggauacaaccagggcaucaucgauugucugauuccucaagaguggauccagcauuucuaucaggaaucugcccccagccaguccgacguggcucucauucgcuacguuaacccggauacagggcggacccuguuugaggccaagcugcacagaucuggauauaucaccguggcgcacagcggcgacuacccucuggucgugcccgcuaaugggcauuuccgcuuugacuccugggugaaccaauucuauagccucgccccuaugggcacaggaaauggccggagacgcgcccaguga

SEQ ID NO: 28964 - RNA, 1623 nt, Artificial Sequence
  derived and/or modified sequence opt5 from VP1__Norovirus_and/or_Norovirus-like__KX168456
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacgugggguccgaugcccccggaagcacacgcgcgcaacaggccugggucuccaccuauucuccgcaguucgugccuaaacuuggcagcgucaaucugagaauuuccgacaacgaugacuuucaguuccaacccacaaaguuuacccccguggggguuaaugaugacgauggaggccacccuuuccggcagugggaacucccgaacuacagcggcgagcugacgcuuaauaugaaccuggcucccccuguggcccccaauuuuccuggggaacagcuccuguucuuuagaucuuucguccccugcuccggaggcuacaaccaggggaucaucgacugucugauuccucaagaguggauccagcauuuuuaucaggaaagcgcccccucucagagcgauguggcucucauucgcuacguuaacccggacacaggacggacccuguucgaggccaagcugcacagauccggcuauaucaccguggcgcacucuggggauuacccucuggucgugcccgcuaauggccauuuucgcuucgacagcugggugaaccaauucuauucccucgccccuaugggaacaggcaaugggcggagacgcgcccaguga

SEQ ID NO: 28965 - RNA, 1623 nt, Artificial Sequence
  derived and/or modified sequence opt5 from VP1__Norovirus_and/or_Norovirus-like__KX168444
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucaucgauugucugauuccucaagaguggauccagcauuuuuaucaggaauccagccccucucagagcgacguggcccucauuagauacguuaauccggauacagggcggacccuguucgaggcuaagcugcacagauccggauauaucaccguggcccacucuggcgacuacccucuggucgugcccgcgaacgggcauuuucgcuucgacagcugggugaaucaauucuauucccucgcuccuaugggcacaggaaacggccggagacgcgcccaguga

SEQ ID NO: 28966 - RNA, 1623 nt, Artificial Sequence
  derived and/or modified sequence opt5 from VP1__Norovirus_and/or_Norovirus-like__KX216806
augaagauggccaccaacgacgcugcccccagcaaugauggcgcggcugggcuggugccugagggaaacaaugaaacacucccgcuggagcccgucgccggcgccgcuaucgccgcuccuguuacggggcagaacaauauuaucgaccccuggauuagaaccaacuucgugcaagccccuaauggagaauuuacagugucuccccggaacuccccuggcgagauccuucugaaucucgaacuggggccggaucuuaaccccuaccuggcgcaccucagccgcauguauaauggauacgccggcggcgucgaggugcagguucugcuggcugggaacgccuucaccgcuggaaaaauucucuuugccgcggugccucccaauuucccugucgaguuucugucccccgcccagaucacaaugcuuccgcaucugaucguggacguuagaacccucgaaccuauuaugaucccccugccugaugugcggaacacauucuuucacuauucuaaucagcccaacagccgcaugagacuugucgcuaugcuguacacgccccuccgguccaacggcucuggggacgauguguucaccgugagcugccgcguccugaccagaccuacaccggacuuugaguucaccuaucugguucccccuuccguggaaagcaagacaaaacccuuuucucucccuauucugacccuuuccgagcugacgaauagccgguuccccgugccgaucgauucucucuuuacagcccaaaacaauguccuucaggugcagugucagaacggacgcugcacccuugacggcgagcugcaagggacaacccagcuccugccuuccggaauuugugcuuucagaggccggguuaccgcccagaucaaucagcgcgauagauggcauaugcaacugcagaaccucaauggcacaacguacgaccccaccgaugacgugccugcuccccuggggacaccugacuucaagggagucguguuuggcaugguuagccagcggaacguggggaaugaugcccccggaucuacccgcgcgcaacaggccugggucuccacauauagcccgcaguucgugccuaaacuuggcuccgucaaccugagaauuucugacaaugaugacuuucaguuccaacccaccaaguuuacgcccguggggguuaacgaugacgaugacggacacccuuuccggcagugggaacucccgaauuacagcggcgagcugacacuuaacaugaaucuggcucccccuguggcccccaacuuuccuggcgaacagcuccuguucuuuagauccuucguccccugcagcgggggauacaaccagggcaucaucgauugucugauuccucaagaguggauccagcauuuuuaucaggaaucugcccccucccagagcgacguggcucucauucgcuacguuaauccggauaccgggcggacccuguucgaggccaagcugcacagaucuggauauaucacaguggcgcacagcggcgacuacccucuggucgugcccgcuaacgggcauuuucgcuucgacuccugggugaaucaauucuauucucucgccccuaugggcaccggaaacggccggagacgcgcccaguga

SEQ ID NO: 28967 - RNA, 1623 nt, Artificial Sequence
  derived and/or modified sequence opt5 from VP1__Norovirus_and/or_Norovirus-like__KX216794
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuugugagcugaccaauagccgguuccccgugccgaucgauucucucuuuacggcccaaaacaauguccuucaggugcagugccagaacggacgcuguacacuugacggcgagcugcaagggaccacacagcuccugccuuccggaauuugcgcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuagccagcggaacguggggaaugaugcccccggaucuacacgcgcgcaacaggccugggucuccaccuauagcccgcaguucgugccuaaacuuggcuccgucaaccugagaauuucugacaaugaugacuuucaguuccaacccacaaaguuuacccccguggggguuaacgaugacgaugacggacacccuuuccggcagugggaacucccgaauuacagcggcgagcugacgcuuaacaugaaucuggcucccccuguggcccccaacuuuccuggcgaacagcuccuguucuuuagauccuucguccccuguagcgggggauacaaccagggcaucaucgauugccugauuccucaagaguggauccagcauuuuuaucaggaaucugcccccucccagagcgacguggcucucauucgcuacguuaauccggauacagggcggacccuguucgaggccaagcugcacagaucuggauauaucaccguggcgcacagcggcgacuacccucuggucgugcccgcuaacgggcauuuucgcuucgacuccugggugaaucaauucuauucucucgccccuaugggcacaggaaacggccggagacgcgcccaguga

SEQ ID NO: 28968 - RNA, 1623 nt, Artificial Sequence
  derived and/or modified sequence opt5 from VP1__Norovirus_and/or_Norovirus-like__KX420895
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaagauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaaugcucugcagguccagugucagaacggacgcugcacacuugacggcgagcugcaagggaccacacagcuccugccuagcggaauuugugccuucagaggccgggugaccgcccagaucaaucagcgcgauagauggcauaugcaacugcagaaccucaauggcaccacauacgaccccacggaugacguuccugcuccccuggggaccccugacuucaagggaguggucuuuggcauggugucucagcggaacguugggaaugaugcgcccggauccacacgcgcccaacaggcuugggugagcaccuauuccccgcaguucgucccuaaacuuggcucugugaaccugagaauuagcgacaaugaugacuuucaguuccaacccacaaaguuuacccccgucggggugaacgaugacgaugacggacacccuuuccggcagugggaacucccgaauuacuccggcgagcugacgcuuaacaugaaucuggcucccccuguugcccccagcuuuccuggcgaacagcuccuguucuuuagaucuuucgugcccugcuccgggggauacaaccagggcaucaucgauugucugauuccucaagaguggauccagcauuuuuaucaggaaagcgcccccucucagagcgacgucgcccucauucgcuacgugaacccggauacagggcggacccuguucgaggcgaaacuucacagauccggauauaucaccguugcucacucuggcgacuacccucuggugguccccgccaaugggcauuuucgcuucgacagcugggugaaccaauucuauucccucgccccuaugggcacaggaaauggccggagacgcgcucaguga

SEQ ID NO: 28969 - RNA, 1623 nt, Artificial Sequence
  derived and/or modified sequence opt5 from VP1__Norovirus_and/or_Norovirus-like__KT591501
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgagauucaggugcugcuggcugggaacgccuucacagcuggaaagauccucuuugccgcgguuccucccaauuucccuguggaguuucugucucccgcccagaucaccaugcuuccgcaucugauugucgacgugagaacacucgaaccuaucaugauuccccugccugauguucggaacaccuucuuucacuauagcaaucagcccaacucccgcaugagacuuguggcuaugcuguacacaccccuccggucuaacggcagcggggacgaugucuucaccguguccugccgcgugcugacgagaccuaccccggacuuugaguucacauaucugguucccccuagcgucgaaucuaagaccaaacccuuuucccucccuauccugacacuuagcgagcugaccaauucucgguuccccgugccgauugauucccucuuuacggcccaaaacaaugugcugcagguccagugucagaacggacgcugcacacuugacggcgagcugcaagggaccacacagcuccugccuagcggaaucugugcuuucagaggccgggugaccgcccagauuaaucagcgcgauagauggcauaugcaacugcagaaccucaauggcaccacauacgaccccacggaugacguuccugcuccccuggggaccccugacuucaagggaguggucuuuggcauggugucucagcggaacguuggguccgaugcccccggaagcacacgcgcgcaacaggccuggguguccaccuauucuccgcaguucgucccuaaacuuggcagcgugaaucugagaaucuccgacaacgaugacuuucaguuccaacccacaaaguuuacccccgucggggugaaugaugacgaugacggacacccuuuccggcagugggaacucccgaacuacagcggcgagcugacgcuuaauaugaaccuggcucccccuguugcccccaauuuuccuggcgaacagcuccuguucuuuagaucuuucgugcccugcuccgggggauacaaccagggcaucauugauugucugaucccucaagaguggauucagcauuuuuaucaggaaagcgcccccucucagagcgacgucgcucucauccgcuacgugaacccggauacagggcggacccuguucgaggccaaacuucacagauccggauauauuaccguugcgcacucuggcgacuacccucuggugguccccgcuaaugggcauuuucgcuucgacagcugggugaaccaauucuauucccucgccccuaugggcacaggaaauggccggagacgcgcccaguga

SEQ ID NO: 28970 - RNA, 1623 nt, Artificial Sequence
  derived and/or modified sequence opt5 from VP1__Norovirus_and/or_Norovirus-like__KT315714
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacgugggguccgaugcccccggaagcacacgcgcgcaacaggccuggauuuccaccuauucuccgcaguucgucccuaaacuuggcagcgugaaucugagaaucuccgacaacgaugacuuucaguuccaacccacaaaguuuacccccgucggggugaaugaugacgaugacggacacccuuuccggcagugggaacucccgaacuacagcggcgagcugacgcuuaauaugaaccuggcucccccuguugcccccaauuuuccuggcgaacagcuccuguucuuuagaucuuucgugcccugcuccgggggauacaaccagggcaucauugauugucugaucccucaagaguggauucagcauuuuuaucaggaaagcgcccccucucagagcgacgucgcucucauccgcuacgugaacccggauacagggcggacccuguucgaggccaagcugcacagauccggauauauuaccguugcgcacucuggcgacuacccucuggugguccccgcuaaugggcauuuucgcuucgacagcugggugaaccaauucuauucccucgccccuaugggcacaggaaauggccggagacgcgcccaguga

SEQ ID NO: 28971 - RNA, 1623 nt, Artificial Sequence
  derived and/or modified sequence opt5 from VP1__Norovirus_and/or_Norovirus-like__KT315673
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucucccaaaaacagcccuggcgagauccuucugaaucucgaacuggggccggaucuuaaccccuaccuggcgcaccucucccggauguauaauggauacgccggcggcgucgaggugcagguucugcuggcugggaacgccuucacagcuggaaagauucucuuugccgcggugccucccaauuucccugucgaguuucugucucccgcccagaucaccaugcuuccgcaucugaucguggacguucgcacacucgaaccuauuaugaucccccugccugaugugagaaacaccuucuuucacuauagcaaucagcccaacucccggaugcgccuugucgcuaugcuguacacaccccucagaucuaacggcagcggggacgauguguucaccguguccugccggguccugacgcgcccuaccccggacuuugaguucacauaucugguucccccuagcguggaaucuaaaaccaagcccuuuucccucccuauucugacacuuagcgagcugaccaauucuagauuccccgugccgaucgauucccucuuuacggcccaaaacaauguccuucaggugcagugucagaacggacggugcacacuugacggcgagcugcaagggaccacacagcuccugccuagcggaauuugugcuuuccgcggcagaguuaccgcccagaucaaucagcgggaucgcuggcauaugcaacugcagaaccucaauggcaccacauacgaccccacggaugacgugccugcuccccuggggaccccugacuucaaaggagucguguuuggcaugguuucucagagaaacguggggaaugaugcccccggauccacacgggcgcaacaggccugggucagcaccuauuccccgcaguucgugccuaagcugggcucugucaaccugcgcauuagcgacaaugaugacuuucaguuccaacccacaaaguuuacccccguggggguuaacgaugacgaugacggacacccuuucagacagugggaacucccgaauuacuccggcgagcugacgcuuaacaugaaucuggcucccccuguggcccccaacuuuccuggcgaacagcuccuguucuuucggagcuucguccccugcucugggggauacaaccagggcaucaucgauugucugauuccucaagaguggauccagcauuuuuaucaggaauccgcccccagccagucugacguggcucucauuagauacguuaauccggauacagggcgcacccuguucgaggccaaacuucaccggagcggauauaucaccguggcgcacuccggcgacuacccucuggucgugcccgcuaacgggcauuuuagauucgacucuugggugaaucaauucuauagccucgccccuaugggcacaggaaacggccgccggagagcccaguga

SEQ ID NO: 28972 - RNA, 1623 nt, Artificial Sequence
  derived and/or modified sequence opt5 from VP1__Norovirus_and/or_Norovirus-like__KX216792
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcauaacucccgcaugagacuugucgcuaugcuguacacaccccuccggucuaacggcagcggggacgauguguucaccguguccugccgcguccugacgagacccaccccugacuuugaguucacauaucugguuccgcccagcguggaaucuaagaccaaaccuuuuucccuccccauucugacacuuagcgagcugaccaauucucgguucccugugcccaucgauucccucuuuacggcccaaaacaauguccuucaggugcagugucagaacggacgcugcacacuggacggcgagcugcaagggaccacacagcuccugccgagcggaauuugugcuuucagaggccggguuaccgcccagaucaaucagcgcgauagauggcacaugcaacugcagaaccucaauggcaccacauacgacccuacggaugacgugcccgccccucuggggacccccgacuucaagggagucguguuuggcaugguuucucagcggaacguggggaaugaugcuccuggauccacacgcgcgcaacaggccugggucagcaccuauagcccccaguucgugccgaaacuuggcucugucaacuuuagaauuagcgacaaugaugacuuccaguuucaaccuacaaaguucacccccguggggguuaacgaugacgaugacggacaucccuuucggcagugggaacugccuaauuacuccggcgagcucacgcugaacaugaaucuugcuccgcccguggccccuaacuuccccggcgaacagcugcucuuuuucagauccuuugucccuugcucugggggauacaaccagggcaucaucgauugucugauuccccaagaguggauccagcacuucuaucaggaauccgccccuagccagucugacguggcucugauucgcuacguuaaucccgauacagggcggacccucuuugaggccaagcugcacagaagcggauauaucaccguggcgcauuccggcgacuacccgcuugucgugccugcuaacgggcacuuccgcuucgacucuugggugaaucaauuuuauagccuggcccccaugggcacaggaaacggccggagacgcgcccaguga

SEQ ID NO: 28973 - RNA, 1623 nt, Artificial Sequence
  derived and/or modified sequence opt5 from VP1__Norovirus_and/or_Norovirus-like__KU953398
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggacagaugcccccggauccacccgcgcgcaacaggccugggucagcacauauuccccgcaguucgugccuaaacuuggcucugucaaucugagaauuagcgacaacgaugacuuucaguuccaacccaccaaguuuacgcccguggggguuaaugaugacgaugacggacacccuuuccggcagugggaacucccgaacuacuccggcgagcugacacuuaauaugaaccuggcucccccuguggcccccaauuuuccuggcgaacagcuccuguucuuucgcagcuucguccccugcucugggggauacaaccagggcaucaucgauugucugauuccucaagaguggauccagcauuuuuaucaggaauccgcccccagccagucugacguggcucucauuagauacguuaacccggauaccgggcggacccuguucgaggccaagcugcacagaagcggauauaucacaguggcgcacuccggcgacuacccucuggucgugcccgcuaaugggcauuuucgcuucgacucuugggugaaccaauucuauagccucgccccuaugggcaccggaaauggccggagacgcgcccaguga

SEQ ID NO: 28974 - RNA, 1623 nt, Artificial Sequence
  derived and/or modified sequence opt5 from VP1__Norovirus_and/or_Norovirus-like__KU557888
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggagcacccagcuccugccuucuggaauuugugcuuucagaggccggguuacagcccagaucaaucagcgcgauagauggcauaugcaacugcagaaccucaauggcaccaccuacgaccccacagaugacgugccugcuccccuggggacgccugacuucaagggagucguguuuggcaugguuucccagcggaacguggggaaugaugcccccggaagcacccgcgcgcaacaggccugggucuccacauauucuccgcaguucgugccuaaacuuggcagcgucaaccugagaauuuccgacaaugaugacuuucaguuccaacccaccaaguuuacacccguggggguuaacgaugacgaugacggacacccuuuccggcagugggaacucccgaauuacagcggcgagcugacccuuaacaugaaucuggcucccccuguggcccccaacuuuccuggcgaacagcuccuguucuuuagaucuuucguccccugcuccgggggauacaaccagggcaucaucgauugucugauuccucaagaguggauccagcauuuuuaucaggaaagcgcccccucucagagcgacguggcucucauucgcuacguuaauccggauacggggcggacacuguucgaggccaagcugcacagauccggauauaucaccguggcgcacucuggcgacuacccucuggucgugcccgcuaacgggcauuuucgcuucgacagcugggugaaucaauucuauucccucgccccuaugggcaccggaaacggccggagacgcgcccaguga

SEQ ID NO: 28975 - RNA, 1623 nt, Artificial Sequence
  derived and/or modified sequence opt5 from VP1__Norovirus_and/or_Norovirus-like__KU557808
augaagauggccagcaacgacguggcucccuccaaugauggcgccgcggggcuggucccugagggaaacaaugaaacccucccgcuggagcccguugcuggcgccgccaucgcugccccugugacagggcagaacaauauuaucgaccccuggauuagaacgaacuucgugcaagcuccuaauggagaauuuaccgucucuccccggaacagcccuggcgagauccuucugaaucucgaacuggggccggaucuuaaccccuaccuggcccaccucucccgcauguauaauggauacgcgggcggcguggagguucaggugcugcuggccgggaacgcuuucacagccggaaagauucucuuugcugccgucccucccaauuucccuguggaguuucugucucccgcgcagaucaccaugcuuccgcaucugaucguugacgugagaacacucgaaccuauuaugaucccccugccugauguccggaacaccuucuuucacuauagcaaucagcccaacucccgcaugagacuuguggccaugcuguacacaccccuccggucuaacggcagcggggacgauguguucaccgucuccugccgcguucugacgagaccuaccccggacuuugaguucacauaucuggugcccccuagcguggaaucuaagaccaaacccuuuucccucccuauucugacacuuagcgagcugaccaauucucgguuccccgucccgaucgauucccucuuuacggcucaaaacaaugugcugcagguucagugucagaacggacgcugcacacuugacggcgagcugcaagggaccacacagcuccugccuagcggaauuugugccuucagaggccgggugaccgcucagaucaaucagcgcgauagauggcauaugcaacugcagaaccucaauggcaccacauacgaccccacggaugacgucccugcuccccuggggaccccugacuucaagggagugguuuuuggcauggugucucagcggaacgucgggaaugaugcccccggauccacacgcgcccaacaggcgugggugagcaccuauuccccgcaguucgucccuaaacuuggcucugugaaccugagaauuagcgacaaugaugacuuucaguuccaacccacaaaguuuacccccguuggggugaacgaugacgaugacggacacccuuuccggcagugggaacucccgaauuacuccggcgagcugacgcuuaacaugaaucuggcucccccugucgcccccaacuuuccuggcgaacagcuccuguucuuucgcagcuucgugcccugcucugggggauacaaccagggcaucaucgauugucugauuccucaagaguggguucagcauuuuuaucaggaauccgcccccagccagucugacguggcccucaucagauacgucaauccggauacagggcggacccuguucgaggcuaaacuucacagaagcggauauauuaccguggcccacuccggcgacuacccucuggugguucccgcgaacgggcauuuucgcuucgacucuugggucaaucaauucuauagccucgcuccuaugggcacaggaaacggccggagacgcgcccaguga

SEQ ID NO: 28976 - RNA, 1623 nt, Artificial Sequence
  derived and/or modified sequence opt5 from VP1__Norovirus_and/or_Norovirus-like__KU557807
augaagauggccagcaacgacguggcucccuccaaugauggcgccgcggggcuggucccugagggaaacaaugaaacccucccgcuggagcccguugcuggcgccgccaucgcugccccugugacagggcagaacaauauuaucgaccccuggauuagaacgaacuucgugcaagcuccuaauggagaauuuaccgucucuccccggaacagcccuggcgagauccuucugaaucucgaacuggggccggaucuuaaccccuaccuggcccaccucucccgcauguauaauggauacgcgggcggcguggagguucaggugcugcuggccgggaacgcuuucacagccggaaagauucucuuugcugccgucccucccaauuucccuguggaguuucugucucccgcgcagaucaccaugcuuccgcaucugaucguugacgugagaacacucgaaccuauuaugaucccccugccugauguccggaacaccuucuuucacuauagcaaucagcccaacucccgcaugagacuuguggccaugcuguacacaccccuccggucuaacggcagcggggacgauguguucaccgucuccugccgcguucugacgagaccuaccccggacuuugaguucacauaucuggugcccccuagcguggaaucuaagaccaaacccuuuucccucccuauucugacacuuagcgagcugaccaauucucgguuccccgucccgaucgauucccucuuuacggcucaaaacaaugugcugcagguucagugucagaacggacgcugcacacuugacggcgagcugcaagggaccacacagcuccugccuagcggaauuugugccuucagaggccgggugaccgcucagaucaaucagcgcgauagauggcauaugcaacugcagaaccucaauggcaccacauacgaccccacggaugacgucccugcuccccuggggaccccugacuucaagggagugguuuuuggcauggugucucagcggaacgucgggaaugaugcccccggauccacacgcgcccaacaggcgugggugagcaccuauuccccgcaguucgucccuaaacuuggcucugugaaccugagaauuagcgacaaugaugacuuucaguuccaacccacaaaguuuacccccguuggggugaacgaugacgaugacggacacccuuuccggcagugggaacucccgaauuacuccggcgagcugacgcuuaacaugaaucuggcucccccugucgcccccaacuuuccuggcgaacagcuccuguucuuucgcagcuucgugcccugcucugggggauacaaccagggcaucaucgauugucugauuccucaagaguggauccagcauuuuuaucaggaauccgcccccagccagucugacguugcccucauuagauacgugaauccggauacagggcggacccuguucgaggcuaaacuucacagaagcggauauaucaccgucgcccacuccggcgacuacccucugguggugcccgcgaacgggcauuuucgcuucgacucuuggguuaaucaauucuauagccucgcuccuaugggcacaggaaacggccggagacgcgcccaguga

SEQ ID NO: 28977 - RNA, 1623 nt, Artificial Sequence
  derived and/or modified sequence opt5 from VP1__Norovirus_and/or_Norovirus-like__KX371111
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuaccggaauuugugcuuucagaggccggguuaccgcccagaucaaucagcgcgauagauggcauaugcaacugcagaaccucaauggcacaacguacgaccccaccgaugacgugccugcuccccuggggacaccugacuucaagggagucguguuuggcaugguuagccagcggaacguggggucugaugcccccggauccacccgcgcgcaacaggccugggucagcacauauuccccgcaguucgugccuaaacuuggcucugucaaucugagaauuagcgacaacgaugacuuucaguuccaacccaccaaguuuacgcccguggggguuaaugaugacgaugacggacacccuuuccggcagugggaacucccgaacuacuccggcgagcugacacuuaauaugaaccuggcucccccuguggcccccaauuuuccuggcgaacagcuccuguucuuucgcagcuucguccccugcucugggggauacaaccagggcaucaucgauugucugauuccucaagaguggauccagcauuuuuaucaggaauccgcccccagccagucugacguggcucucauuagauacguuaacccggauaccgggcggacccuguucgaggccaagcugcacagaagcggauauaucacaguggcgcacuccggcgacuacccucuggucgugcccgcuaaugggcauuuucgcuucgacucuugggugaaccaauucuauagccucgccccuaugggcaccggaaauggccggagacgcgcccaguga

SEQ ID NO: 28978 - RNA, 1623 nt, Artificial Sequence
  derived and/or modified sequence opt5 from VP1__Norovirus_and/or_Norovirus-like__KX371110
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcaugaucgcuggcacaugcaacugcagaaccucaauggcaccacauacgaccccacggaugacgugccugcuccccuggggaccccugacuucaagggagucguguuuggcaugguuucucagagaaacguggggacagaugcccccggauccacccgggcgcaacaggccugggucagcacauauuccccgcaguucgugccuaaacuuggcucugucaaucugcgcauuagcgacaacgaugacuuucaguuccaacccaccaaguuuacgcccguggggguuaaugaugacgaugacggacauccuuucagacagugggaacucccgaacuacuccggcgagcugacacuuaauaugaaccuggcucccccuguggcccccaauuuuccuggcgaacagcuccuguucuuucggagcuucguccccugcucugggggauacaaccagggcaucaucgauugucugauuccucaagaguggauccagcacuuuuaucaggaauccgcccccagccagucugacguggcucucauuagauacguuaacccggauaccgggcgcacccuguucgaggccaagcugcaccggagcggauauaucacaguggcgcauuccggcgacuacccucuggucgugcccgcuaaugggcacuuuagauucgacucuugggugaaccaauucuauagccucgccccuaugggcaccggaaauggccgccggagagcccaguga

SEQ ID NO: 28979 - RNA, 1623 nt, Artificial Sequence
  derived and/or modified sequence opt5 from VP1__Norovirus_and/or_Norovirus-like__KX134669
augaagauggccagcuccgacgcugcccccucuaacgauggcgcggcugggcuggugccugagggaaauaacgaaacccucccgcuggagcccgucgccggcgccgcuaucgccgcuccuguuacagggcagaauaacauuaucgaccccuggauuagaacgaauuucgugcaagccccuaacggagaauuuaccgugagcccccgcaauuccccuggcgagauccuucugaaccucgaacuggggccggaucuuaaucccuaccuggcgcaccucucucggauguauaacggauacgccggcggcgucgaggugcagguucugcuggcugggaaugccuucacagcuggaaaaauucucuuugccgcggugccucccaacuucccugucgaguuucugagccccgcccagaucaccaugcuuccgcaucugaucguggacguuagaacacucgaaccuauuaugaucccccugccugaugugcggaauaccuucuuucacuauuccaaccagcccaauucucgcaugagacuugucgcuaugcuguacacaccccuccggagcaacggcuccggggacgauguguucaccgugagcugccgcguccugacgagaccuaccccggacuuugaguucacauaucugguucccccuucuguggaauccaagaccaaacccuuuagccucccuauucugacacuuucugagcugaccaacucccgguuccccgugccgaucgauagccucuuuacggcccaaaauaacguccuucaggugcagugucagaauggacgcugcacacuugacggcgagcugcaagggaccacacagcuccugccuucuggaauuugugcuuucagaggccggguuaccgcccagaucaaccagcgcgauagauggcauaugcaacugcagaaucucaacggcaccacauacgaccccacggaugacgugccugcuccccuggggaccccugacuucaagggagucguguuuggcaugguuucccagcggaauguggggaacgaugcccccggaagcacacgcgcgcaacaggccugggucuccaccuauucuccgcaguucgugccuaaacuuggcagcgucaaucugagaauuuccgacaacgaugacuuucaguuccaacccacaaaguuuacccccguggggguuaaugaugacgaugacggacacccuuuccggcagugggaacucccgaacuacagcggcgagcugacgcuuaauaugaaccuggcucccccuguggcccccaauuuuccuggcgaacagcuccuguucuuuagaucuuucguccccugcuccgggggauacaaccagggcaucaucgauugucugauuccucaagaguggauccagcauuuuuaucaggaaagcgcccccucucagagcgacguggcucucauucgcuacguuaacccggauacagggcggacccuguucgaggccaagcugcacagauccggauauaucaccguggcgcacucuggcgacuacccucuggucgugcccgcuaaugggcauuuucgcuucgacagcugggugaaccaauucuauucccucgccccuaugggcacaggaaauggccggagacgcgcccaguga

SEQ ID NO: 28980 - RNA, 1623 nt, Artificial Sequence
  derived and/or modified sequence opt5 from VP1__Norovirus_and/or_Norovirus-like__KU557871
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaagauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaaugcucugcagguccagugucagaacggacgcugcacacuugacggcgagcugcaagggaccacacagcuccugccuagcggaauuugugccuucagaggccgggugaccgcccagaucaaucagcgcgauagauggcauaugcaacugcagaaccucaauggcaccacauacgaccccacggaugacguuccugcuccccuggggaccccugacuucaagggaguggucuuuggcauggugucucagcggaacguugggaaugaugcgcccggauccacacgcgcccaacaggcuugggugagcaccuauuccccgcaguucgucccuaaacuuggcucugugaaccugagaauuagcgacaaugaugacuuucaguuccaacccacaaaguuuacccccgucggggugaacgaugacgaugacggacacccuuuccggcagugggaacucccgaauuacuccggcgagcugacgcuuaacaugaaucuggcucccccuguugcccccaacuuuccuggcgaacagcuccuguucuuucgcagcuucgugcccugcucugggggauacaaccagggcaucaucgauugucugauuccucaagaguggauccagcauuuuuaucaggaauccgcccccagccagucugacgucgcccucauuagauacgugaauccggauacagggcggacccuguucgaggcgaaacuucacagaagcggauauaucaccguugcucacuccggcgacuacccucuggugguccccgccaacgggcauuuucgcuucgacucuugggugaaucaauucuauagccucgccccuaugggcacaggaaacggccggagacgcgcucaguga

SEQ ID NO: 28981 - RNA, 1623 nt, Artificial Sequence
  derived and/or modified sequence opt5 from VP1__Norovirus_and/or_Norovirus-like__KX371108
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgagauucaggugcugcuggcugggaacgccuucacagcuggaaagauccucuuugccgcgguuccucccaauuucccuguggaguuucugucucccgcccagaucaccaugcuuccgcaucugauugucgacgugagaacacucgaaccuaucaugauuccccugccugauguucggaacaccuucuuucacuauagcaaucagcccaacucccgcaugagacuuguggcuaugcuguacacaccccuccggucuaacggcagcggggacgaugucuucaccguguccugccgcgugcugacgagaccuaccccggacuuugaguucacauaucugguucccccuagcgucgaaucuaagaccaaacccuuuucccucccuauccugacacuuagcgagcugaccaauucucgguuccccgugccgauugauucccucuuuacggcccaaaacaaugugcugcagguccagugucagaacggacgcugcacacuugacggcgagcugcaagggaccacacagcuccugccuaccggaaucugugcuuucagaggccgggugaccgcccagauuaaucagcgcgauagauggcauaugcaacugcagaaccucaauggcacaacguacgaccccaccgaugacguuccugcuccccuggggacaccugacuucaagggaguggucuuuggcauggugagccagcggaacguugggucugaugcccccggauccacccgcgcgcaacaggccugggugagcacauauuccccgcaguucgucccuaaacuuggcucugugaaucugagaaucagcgacaacgaugacuuucaguuccaacccaccaaguuuacgcccgucggggugaaugaugacgaugacggacacccuuuccggcagugggaacucccgaacuacuccggcgagcugacacuuaauaugaaccuggcucccccuguugcccccaauuuuccuggcgaacagcuccuguucuuucgcagcuucgugcccugcucugggggauacaaccagggcaucauugauugucugaucccucaagaguggauucagcauuuuuaucaggaauccgcccccagccagucugacgucgcucucaucagauacgugaacccggauaccgggcggacccuguucgaggccaaacuucacagaagcggauauauuacaguugcgcacuccggcgacuacccucuggugguccccgcuaaugggcauuuucgcuucgacucuugggugaaccaauucuauagccucgccccuaugggcaccggaaauggccggagacgcgcccaguga

SEQ ID NO: 28982 - RNA, 1623 nt, Artificial Sequence
  derived and/or modified sequence opt5 from VP1__Norovirus_and/or_Norovirus-like__KU557829
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuacggaccccuggaucagaaccaacuucgugcaagccccuaauggagaauuuacagugucuccccggaacagcccuggcgagauucuucugaaucucgaacuggggccggaucuuaaccccuaccuggcgcaccucucccgcauguauaauggauacgccggcggcgucgaggugcagguucugcuggcugggaacgccuucaccgcuggaaaaauccucuuugccgcggugccucccaauuucccugucgaguuucugucucccgcccagauuacaaugcuuccgcaucugaucguggacguuagaacccucgaaccuaucaugauuccccugccugaugugcggaacacauucuuucacuauagcaaucagcccaacucccgcaugagacuugucgcuaugcuguacacgccccuccggucuaacggcagcggggacgauguguucacgguguccugccgcguccugaccagaccuacaccggacuuugaguucaccuaucugguucccccuagcguggaaucuaagacaaaacccuuuucccucccuauccugacccuuagcgagcugaccaauucucgguuccccgugccgauugauucccucuuuacagcccaaaacaauguccuucaggugcagugucagaacggacgcugcacccuugacggcgagcugcaagggacaacccagcuccugccuagcggaaucugugcuuucagaggccggguuaccgcccagauuaaucagcgcgauagauggcauaugcaacugcagaaccucaauggcacaacguacgaccccaccgaugacgugccugcuccccuggggacaccugacuucaagggagucguguuuggcaugguuucucagcggaacguggggaaugaugcccccgacuccacccgcgcgcaacaggccugggucagcacauauuccccgcaguucgugccuaaacuuggaucugucaaccugagaaucagcgauaaugacgauuuucaguuccaacccaccaaguuuacgcccgugggcguuaacgacgaugacgaugggcacccuuuccggcagugggaacucccgaauuacuccggagagcugacacuuaacaugaaucuggcucccccuguggcccccaacuuuccuggcgaacagcuccuguucuuucgcagcuucguccccugcucuggcggguacaaccagggaauuaucgacugucugaucccucaagaguggauucagcauuuuuaucaggaauccgcccccagccagucugauguggcucucaucagauacguuaauccggacaccggccggacccuguucgaggccaagcugcacagaagcggguauauuacaguggcgcacuccggagacuacccucuggucgugcccgcuaacggccauuuucgcuucgauucuugggugaaucaauucuauagccucgccccuauggggaccggcaacggacggagacgcgcccaguga

SEQ ID NO: 28983 - RNA, 1623 nt, Artificial Sequence
  derived and/or modified sequence opt5 from VP1__Norovirus_and/or_Norovirus-like__KX168452
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaagauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgccccgaucgauucccucuuuacggcucaaaacaaugugcugcagguccagugucagaacggacgcugcacacuugacggcgagcugcaagggaccacacagcuccugccuagcggaauuugugccuucagaggccgggugaccgcccagaucaaucagcgcgauagauggcauaugcaacugcagaaccucaauggcaccacauacgaccccacggaugacguuccugcuccccuggggaccccugacuucaagggaguggucuuuggcauggugucucagcggaacguuggguccgaugcgcccggaagcacacgcgcccaacaggcuuggguguccaccuauucuccgcaguucgucccuaaacuuggcagcgugaaucugagaauuuccgacaacgaugacuuucaguuccaacccacaaaguuuacccccgucggggugaaugaugacgaugacggacacccuuuccggcagugggaacucccgaacuacagcggcgagcugacgcuuaauaugaaccuggcucccccuguugcccccaauuuuccuggcgaacagcuccuguucuuuagaucuuucgugcccugcuccgggggauacaaccagggcaucaucgauugucugauuccucaagaguggauccagcauuuuuaucaggaaagcgcccccucucagagcgacgucgcccucauucgcuacgugaacccggauacagggcggacccuguucgaggcgaaacuucacagauccggauauaucaccguugcucacucuggcgacuacccucuggugguccccgccaaugggcauuuucgcuucgacagcugggugaaccaauucuauucccucgccccuaugggcacaggaaauggccggagacgcgcucaguga

SEQ ID NO: 28984 - RNA, 1623 nt, Artificial Sequence
  derived and/or modified sequence opt5 from VP1__Norovirus_and/or_Norovirus-like__KU953393
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcucuauuugugcuuucagaggacggguuaccgcccagaucaaucagcgcgauagauggcauaugcaacugcagaaccucaauggcaccacauacgaccccacggaugacgugccugcuccccugggcaccccugacuucaagggggucguguuuggaaugguuucccagcggaacgugggcagcgaugcccccggguccacacgcgcgcaacaggccugggucucuaccuauagcccgcaguucgugccuaaacuuggauccgucaaucugagaauuagcgacaacgaugacuuucaguuccaacccacaaaguuuacccccgugggcguuaaugaugacgaugacgggcacccuuuccggcagugggaacucccgaacuacucuggagagcugacgcuuaauaugaaccuggcucccccuguggcccccaauuuuccuggcgaacagcuccuguucuuuagauccuucguccccugcagcggcggguacaaccagggaaucaucgauugucugauuccucaagaguggauccagcauuuuuaucaggaaucugcccccagccaguccgacguggcucucauucgcuacguuaacccggauacaggccggacccuguucgaggccaagcugcacagaucuggguauaucaccguggcgcacagcggagacuacccucuggucgugcccgcuaauggccauuuucgcuucgacuccugggugaaccaauucuauagccucgccccuauggggacaggcaauggacggagacgcgcccaguga

SEQ ID NO: 28985 - RNA, 1623 nt, Artificial Sequence
  derived and/or modified sequence opt5 from VP1__Norovirus_and/or_Norovirus-like__KR052020
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucaucgauugucugauuccucaagaguggauccagcauuuuuaucaggaauccgcccccagccagccggacguggcucucauuagauacguuaauccugauacagggcggacccuguucgaggccaagcugcacagaucuggauauaucaccguggcgcacagcggcgacuacccccuggucgugccugcuaacgggcauuuucgcuucgacuccugggugaaucaauucuauucucucgcccccaugggcacaggaaacggccggagacgcgcccaguga

SEQ ID NO: 28986 - RNA, 1623 nt, Artificial Sequence
  derived and/or modified sequence opt5 from VP1__Norovirus_and/or_Norovirus-like__KT315687
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaagcaacguccuucaggugcagugucagaauggacgcugcacacuugacggcgagcugcaagggaccacacagcuccugccuaccggaauuugugcuuucagaggccggguuaccgcccagaucaaccagcgcgauagauggcauaugcaacugcagaaucucaacggcacaacguacgaccccaccgaugacgugccugcuccccuggggacaccugacuucaagggagucguguuuggcaugguuucucagcggaauguggggaacgaugcccccggauccacccgcgcgcaacaggccugggucagcacauauuccccgcaguucgugccuaaacuuggcucugucaaucugagaauuagcgacaacgaugacuuucaguuccaacccaccaaguuuacgcccguggggguuaaugaugacgaugacggacacccuuuccggcagugggaacucccgaacuacuccggcgagcugacacuuaauaugaaccuggcucccccuguggcccccaauuuuccuggcgaacagcuccuguucuuucgcagcuucguccccugcucugggggauacaaccagggcaucaucgauugucugauuccucaagaguggauccagcauuuuuaucaggaauccgcccccagccagucugacguggcucucauuagauacguuaacccggauaccgggcggacccuguucgaggccaagcugcacagaagcggauauaucacaguggcgcacuccggcgacuacccucuggucgugcccgcuaaugggcauuuucgcuucgacucuugggugaaccaauucuauagccucgccccuaugggcaccggaaauggccggagacgcgcccaguga

SEQ ID NO: 28987 - RNA, 1623 nt, Artificial Sequence
  derived and/or modified sequence opt5 from VP1__Norovirus_and/or_Norovirus-like__KX356908
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugagcucugauauuugugcuuucagaggacggguuaccgcccagaucaaucagcgcgacagauggcauaugcaacugcagaaccucaauggcaccacauacgauccuacggacgacgugcccgccccucugggcacccccgauuucaagggggucguguuuggaaugguuucccagcggaacgugggcagcgacgcuccuggguccacacgcgcgcaacaggccugggucucuaccuauagcccccaguucgugccgaaacuuggauccgucaaucugagaauuagcgauaacgacgauuuucaguuccaaccuacaaaguuuacccccgugggcguuaaugacgaugacgaugggcaccccuuccggcagugggaacucccuaacuacucuggagagcugacgcuuaauaugaaccuggcuccgcccguggccccuaauuuucccggcgaacagcuccuguucuuuagauccuucgucccuugcagcggcggguacaaccagggaaucaucgacugucugauuccccaagaguggauccagcauuuuuaucaggaaucugccccuagccaguccgauguggcucucauucgcuacguuaaccccgacacaggccggacccuguucgaggccaagcugcacagaucuggguauaucaccguggcgcacagcggagaccauccgcuggucgugccugcuaauggccacuuucgcuucgauuccugggugaaccaauucuacagccucgcccccauggggacaggcaauggacggagacgcgcccaguga

SEQ ID NO: 28988 - RNA, 1623 nt, Artificial Sequence
  derived and/or modified sequence opt5 from VP1__Norovirus_and/or_Norovirus-like__KX024652
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaccccacaaaguuuacccccguggggguuaacgaugacaaugauggaccuccguuccggcaaugggaacuccccaacuacuccggcgagcugacgcuuaauaugaaccuggcuccucccguggccccuaacuuucccggcgaacagcuccuguucuuucgcagcuucgucccuugcucugggggauacaaucagggcaucaucgacugucugauuccccaggaguggauccaacauuuuuaucaggaauccgccccgagccagucugauguggcucucauuagauacguuaacccugacacagggcggacccuguucgaggccaagcugcacagaagcggauauaucaccguggcgcacuccggcgauuacccccuggucgugccugcuaaugggcauuuucgcuucgacucuugggugaaccaguucuauagccucgcccccaugggcacaggaaauggccggagacgcgcccaauga

SEQ ID NO: 28989 - RNA, 1623 nt, Artificial Sequence
  derived and/or modified sequence opt5 from VP1__Norovirus_and/or_Norovirus-like__KT315706
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccagcgacuuugaguucacauaucugguuccgcccucuguggaauccaagaccaaaccuuuuagccuccccauucugacacuuucugagcugaccaauucccgguucccugugcccaucgauagccucuuuacggcccaaaacaauguccuucaggugcagugucagaacggacgcugcacacuugacggcgagcugcaagggaccacacagcuccugccgucuggaauuugugcuuucagaggccggguuaccgcccagaucaaucagcgcgauagauggcauaugcaacugcagaaccucaauggcaccacauacgacccuacggaugacgugcccgccccucuggggacccccgacuucaagggagucguguuuggcaugguuucccagcggaacguggggaaugaugcuccuggaagcacacgcgcgcaacaggccugggucuccaccuauucuccccaguucgugccgaaacuuggcagcgucaaccugagaauuuccgacaaugaugacuuucaguuccaaccuacaaaguuuacccccguggggguuaacgaugacgaugacggacaccccuuccggcagugggaacucccuaauuacagcggcgagcugacgcuuaacaugaaucuggcuccgcccguggccccuaacuuucccggcgaacagcuccuguucuuuagaucuuucgucccuugcuccgggggauacaaccagggcaucaucgauugucugauuccccaagaguggauccagcauuuuuaucaggaaagcgccccuucucagagcgacguggcucucauucgcuacguuaaucccgauacagggcggacccuguucgaggccaagcugcacagauccggauauaucaccguggcgcacucuggcgacuacccgcuggucgugccugcuaacgggcauuuucgcuucgacagcugggugaaucaauucuauucccucgcccccaugggcacaggaaacggccggagacgcgcccaguga

SEQ ID NO: 28990 - RNA, 1623 nt, Artificial Sequence
  derived and/or modified sequence opt5 from VP1__Norovirus_and/or_Norovirus-like__KX134670
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgaugccuaccccggacuuugaguucacauaucugguucccccuagcguggaaucuaagaccaaacccuuuucccucccuauucugacacuuagcgagcugaccaauucuagauuccccgugccgaucgauucccucuuuacggcccaaaacaauguccuucaggugcagugucagaacggacggugcacacuugacggcgagcugcaagggaccacacagcuccugccuaccggaauuugugcuuuccgcggcagaguuaccgcccagaucaaucagcgggaucgcuggcauaugcaacugcagaaccucaauggcacaacguacgaccccaccgaugacgugccugcuccccuggggacaccugacuucaagggagucguguuuggcaugguuagccagagaaacguggggaaugaugcccccggaucuacccgggcgcaacaggccugggucuccacauauagcccgcaguucgugccuaaacuuggcuccgucaaccugcgcauuucugacaaugaugacuuucaguuccaacccaccaaguuuacgcccguggggguuaacgaugacgaugacggacacccuuucagacagugggaacucccgaauuacagcggcgagcugacacuuaacaugaaucuggcucccccuguggcccccaacuuuccuggcgaacagcuccuguucuuucgguccuucguccccugcagcgggggauacaaccagggcaucaucgauugucugauuccucaagaguggauccagcauuuuuaucaggaaucugcccccucccagagcgacguggcucucauuagauacguuaauccggauaccgggcgcacccuguucgaggccaagcugcaccggucuggauauaucacaguggcgcacagcggcgacuacccucuggucgugcccgcuaacgggcauuuuagauucgacuccugggugaaucaauucuauucucucgccccuaugggcaccggaaacggccgccggagagcccaguga

SEQ ID NO: 28991 - RNA, 1623 nt, Artificial Sequence
  derived and/or modified sequence opt5 from VP1__Norovirus_and/or_Norovirus-like__KT780399
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugcacgguccugacccgcccuacaccggacuuugaguucaccuaucugguucccccuagcguggaaucuaagacaaaacccuuuucccucccuauucugacccuuagcgagcugacaaauucuagauuccccgugccgaucgauucccucuuuacggcccaaaacaauguccuucaggugcagugucagaacggacggugcacccuugacggcgagcugcaagggacaacccagcuccugccuaccggaauuugugcuuuccgcggcagaguuacagcccagaucaaucagcgggaucgcuggcauaugcaacugcagaaccucaauggcacgaccuacgaccccacagaugacgugccugcuccccuggggaccccugacuucaagggagucguguuuggcaugguuagccagagaaacguggggaaugaugcccccggaucuacacgggcgcaacaggccugggucuccaccuauagcccgcaguucgugccuaaacuuggcuccgucaaccugcgcauuucugacaaugaugacuuucaguuccaacccacgaaguuuacacccguggggguuaacgaugacgaugacggacacccuuucagacagugggaacucccgaauuacagcggcgagcugacccuuaacaugaaucuggcucccccuguggcccccaacuuuccuggcgaacagcuccuguucuuucgguccuucguccccugcagcgggggauacaaccagggcaucaucgauugucugauuccucaagaguggauccagcauuuuuaucaggaaucugcccccucccagagcgacguggcucucauuagauacguuaauccggauaccgggcgcacacuguucgaggccaagcugcaccggucuggauauaucaccguggcgcacagcggcgacuacccucuggucgugcccgcuaacgggcauuuuagauucgacuccugggugaaucaauucuauucucucgccccuaugggcacaggaaacggccgccggagagcccaguga

SEQ ID NO: 28992 - RNA, 1623 nt, Artificial Sequence
  derived and/or modified sequence opt5 from VP1__Norovirus_and/or_Norovirus-like__KP902577
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugcacgguccugaccacaccuaccccggacuuugaguucacauaucugguucccccuagcguggaaucuaagaccaaacccuuuucccucccuauucugacgcuuagcgagcugacaaauucucgcuuccccgugccgaucgauucccucuuuaccgcccaaaacaauguccuucaggugcagugucagaacggaagaugcacacuugacggcgagcugcaagggaccacccagcuccugccuacaggaauuugugcuuuccggggccgcguuacggcccagaucaaucagagagaucgguggcauaugcaacugcagaaccucaauggcaccacauacgaccccaccgaugacgugccugcuccccuggggacaccugacuucaagggagucguguuuggcaugguuagccagcgcaacguggggaaugaugcccccggaucuaccagagcgcaacaggccugggucuccacguauagcccgcaguucgugccuaaacuuggcuccgucaaccugcggauuucugacaaugaugacuuucaguuccaacccacaaaguuuacccccguggggguuaacgaugacgaugacggacacccuuuccgccagugggaacucccgaauuacagcggcgagcugacccuuaacaugaaucuggcucccccuguggcccccaacuuuccuggcgaacagcuccuguucuuuagauccuucguccccugcagcgggggauacaaccagggcaucaucgauugucugauuccucaagaguggauccagcauuuuuaucaggaaucugcccccucccagagcgacguggcucucauucgguacguuaauccggauacagggagaacccuguucgaggccaagcugcaccgcucuggauauaucacaguggcgcacagcggcgacuacccucuggucgugcccgcuaacgggcauuuucgguucgacuccugggugaaucaauucuauucucucgccccuaugggcacgggaaacggcagacgccgggcccaguga

SEQ ID NO: 28993 - RNA, 1623 nt, Artificial Sequence
  derived and/or modified sequence opt5 from VP1__Norovirus_and/or_Norovirus-like__KU587628
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuuacggagaauuuaccgugucuccccggaauagcccuggcgagauccuucugaaccucgaacuggggccggaucuuaaucccuaucuggcgcaccucucccgcauguacaacggauaugccggcggcgucgaggugcagguucugcuggcugggaaugccuucacagcuggaaaaauucucuuugccgcggugccucccaacuucccugucgaguuucugucucccgcccagaucaccaugcuuccgcaucugaucguggacguuagaacacucgaaccuauuaugaucccccugccugaugugcggaauaccuucuuucacuacagcaaccagcccaauucccgcaugagacuugucgcuaugcuguauacaccccuccggucuaacggcagcggggacgauguguucaccguguccugccgcguccugacgagaccuaccccggacuuugaguucacauaccugguucccccuagcguggaaucuaagaacaaacccuuuucccucccuauuuucacccugagcgagcuuacaaauucucgguuucccgugccgaucgauucccuguucaccgcccaaaacaauguccuccaggugcagugucagaacggacgcugcacgcuggacggcgagcuucaagggacaacccagcugcucccuacaggaauuugugcuuucagaggccggguuaccgcccagaucaaucagcgcgauagauggcauaugcaacugcagaaccugaauggcaccacauaugaccccacggaugacgugccugcuccccucgggaccccugacuuuaagggagucguguucggcaugguuagccagcggaacguggggaaugaugcccccggaucuacacgcgcgcaacaggccugggucuccaccuacagcccgcaguuugugccuaaacugggcuccgucaaccuuagaauuucugacaaugaugacuuccaguuucaacccacaaaguucacccccguggggguuaacgaugacgaugacggacacccuuuucggcagugggaacugccgaauuacagcggcgagcucacgcugaacaugaaucuugcucccccuguggcccccaacuucccuggcgaacagcugcucuuuuucagauccuuuguccccugcagcgggggauauaaccagggcaucaucgauugucugauuccucaagaguggauccagcauuucuaccaggaaucugcccccucccagagcgacguggcucugauucgcuauguuaauccggauacagggcggacccucuuugaggccaagcugcacagaucuggauacaucaccguggcgcacagcggcgacuauccucuugucgugcccgcuaacgggcauuuccgcuucgacuccugggugaaucaauuuuacucucuggccccuaugggcacaggaaacggccggagacgcgcccaguga

SEQ ID NO: 28994 - RNA, 1623 nt, Artificial Sequence
  derived and/or modified sequence opt5 from VP1__Norovirus_and/or_Norovirus-like__AF414409
augaagauggccagcaacgacgcugcccccuccaaugauggcgcggcugggcuggugccugagaucaacaaugaagucaugccgcucgagcccguugccggagccucucuggcuaccccuguggugggccagcaaaacauuaucgaccccuggauuagaaauaacuucguccaggccccugcuggggaauuuacagugagcccccgcaauuccccuggagagauccuucuggaucucgaacugggcccggagcuuaaccccuaccuggcccaccucgcgcggauguauaaugggcaugccggaggcauggagguucagauugugcuggcuggcaacgccuucacggcugggaaaaucaucuuugccgcgauuccucccggauucccuuacgaaaaucugucucccagccagaucaccaugugcccgcacgucauuaucgacgugagacaacucgagccuguucugcuucccaugccugauauucggaacaacuuuuuccauuauaaucagggcaaugaccccaagcugcgccucguggccaugcuguacacaccccuuagagcuaacaacuccggggaugacgucuuuaccgugucuugucgggugcugacaaaaccuagcccggauuucgaauuuaccuuccucguucccccuacagucgaguccaagaccaaacaguuuacgcugcccauccugaagauuagcgagaugaccaauucucgcuucccugugcccguggaaaugauguauacauccagaaacgagaaucaggucgugcaaccgcagaacggacggguuacccucgacggcgaacugcuugggacaaccccucugcucgccgugaauaucugcaaguuuaaaggagaggucaucgcuaagaacggcgaugugcgcagcuacagaauggacauggaaauuacgaauacagauggcacccccaucgacccuacagaggacacccccgggccuauuggaucucccgauuuccagggcauccuguucgggguugccucccagcggaacaaaaaugagcaaaacccggccacccgcagccacgaagcuaauauuaacacaggaggcgaccaguaugcgccuaaacuugcccaggugaagaucuuuucucaaucccaggauuucgagguccaucagcccacgguguuuacccccgucgggguggcuggagacacaagccacccuuucagacaguggacccugccgcgguacggcggccaccucacaaauaacacccaucuggcccccgccguugcuccucuguuucccggggaacaaauccucuucuuucgcucccagauuccuucuagcggaggccacgagcugggguacauggauugucuugugccccaggaauggguccagcauuucuaucaagaggccgcgacggcucaguccgagguggcccugaucagauuuauuaauccugacacaggacggguucucuucgaagccaagcugcacaagcagggcuuuaucaccguggcucacaccggggauaaccccauugucaugccgccuaacggcuacuucagauuugaggccugggugaaucaguucuauagccuugcucccgugggaacaggcaacgggcgccggagaauccaauga

SEQ ID NO: 28995 - RNA, 1623 nt, Artificial Sequence
  derived and/or modified sequence opt5 from VP1__Norovirus_and/or_Norovirus-like__KT943504
augaagauggccagcaacgacgcugcccccuccaaugauggcgcggcugggcuggugccugagaucaacaaugaagucaugccgcucgagcccguugccggagccucucuggcuaccccuguggugggccagcaaaacauuaucgaccccuggauuagaacaaauuucguccaggccccugcuggggaauuuacggugagccccagaaacuccccuggagagauccuucuggaucucgaacugggcccggagcuuaaucccuaccuggcccaccucgcgcgcauguauaacgggcaugccggaggcauggagguucagauugugcuggcuggcaaugccuucaccgcugggaaaaucaucuuugccgcgauuccucccggauucccuuacgaaaaccugucucccagccagaucacaaugugcccgcacgucauuaucgacgugagacaacucgagccuguucugcuucccaugccugauauucggaauaacuuuuuccauuauaaucagggcaacgaccccaagcugcgccucguggccaugcuguacacaccccuuagagcuaauaacuccggggaugacgucuuuaccgugucuugucgggugcugaccaaaccuagcccggauuucgaauuuacauuccucguucccccuaccgucgaguccaagacgaaacaguuuacccugcccauccugaagauuagcgagaugacaaacucucgcuucccugugcccguggaaaugauguauaccgccagaaaugagaaccaggucgugcaaccgcagaauggacggguuacacucgacggcgaacugcuugggaccacgccucugcucgcugugaacaucugcaaguuuaaaggagagaucacagccaaguccgucgaugugcgcagcuacagaauggacauggaaauuaccaauacagauggcacccccaucgacccuaccgaggacacacccggcccuauugggucucccgauuuccggggaauccuguucggcguugccucccagcgcaacaaaggggagcagauuccggcuacgagagcgcacgaagccaauaucaacaccggaggcgaccaauaugcuccuaaacuugcccaggugaaguuuuucagcgggucucaggauuuugagguccaucaacccacaguguucacccccgucggaguggccggcgacuccagccacccuuuucagcagugggcucugccgcgguacggcgggcaccucacaaauaacacccaucuggcccccgcgguugcuccucuguuccccggagaacagauccucuuuuuccgcucccaaauuccuucuagcggcgggcacgagaugggauacauggauugucuggugccccaggaauggguccagcauuuuuaucaggaggccgccacggcucaauccgagguggcccuuaucagauucguuaauccugacacaggccgggugcuguuugaagcuaagcuccacaagcagggguucauuaccgucgcccacaccggcgauaaccccaucgugaugccgccuaauggacauuuuagauucgaggcgugggugaaccaguucuacagccuggcccccguuggcacagggaauggacgccggcggauucaguga

SEQ ID NO: 28996 - RNA, 1623 nt, Artificial Sequence
  derived and/or modified sequence opt5 from VP1__Norovirus_and/or_Norovirus-like__KT943505
augaagauggccagcaacgacgcugcccccuccaaugauggcgcggcugggcuggugccugagaucaacaaugaagucaugccgcucgagcccguugccggagccucucuggcuaccccuguggugggccagcaaaacauuaucgaccccuggauuagaacaaauuucguccaggccccugcuggggaauuuacggugagccccagaaacuccccuggagagauccuucuggaucucgaacugggcccggagcuuaaucccuaccuggcccaccucgcgcgcauguauaacgggcaugccggaggcauggagguucagauugugcuggcuggcaaugccuucaccgcugggaaaaucaucuuugccgcgauuccucccggauucccuuacgaaaaccugucucccagccagaucacaaugugcccgcacgucauuaucgacgugagacaacucgagccuguucugcuucccaugccugauauucggaauaacuuuuuccauuauaaucagggcaacgaccccaagcugcgccucguggccaugcuguacacaccccuuagagcuaauaacuccggggaugacgucuuuaccgugucuugucgggugcugaccaaaccuagcccggauuucgaauuuacauuccucguucccccuaccgucgaguccaagacgaaacaguuuacccugcccauccugaagauuagcgagaugacaaacucucgcuucccugugcccguggaaaugauguauaccgccagaaaugagaaccaggucgugcaaccgcagaauggacggguuacacucgacggcgaacugcuugggaccacgccucugcucgcugugaacaucugcaaguuuaaaggagagaucacagccaaguccgucgaugugcgcagcuacagaauggacauggaaauuaccaauacagauggcacccccaucgacccuaccgaggacacacccggcccuauugggucucccgauuuccggggaauccuguucggcguugccucccagcgcaacaaaggggagcagauuccggcuacgagagcgcacgaagccaauaucaacaccggaggcgaccaauaugcuccuaaacuugcccaggugaaguuuuucagcgggucucaggauuuugagguccaucaacccacaguguucacccccgucggaguggccggcgacuccagccacccuuuucagcagugggcucugccgcgguacggcgggcaccucacaaauaacacccaucuggcccccgcgguugcuccucuguuccccggagaacagauccucuuuuuccgcucccaaauuccuucuagcggcgggcacgagcugggauacauggauugucuugugccccaggaauggguccagcauuuuuaucaggaggccgccacggcucaauccgagguggcccugaucagauucguuaauccugacacaggccgggugcucuuugaagcuaagcugcacaagcagggguucauuaccgucgcccacaccggcgauaaccccaucgugaugccgccuaauggacauuuuagauucgaggcgugggugaaccaguucuacagccuugcccccguuggcacagggaauggacgccggcggauucaguga

SEQ ID NO: 28997 - RNA, 1623 nt, Artificial Sequence
  derived and/or modified sequence opt5 from VP1__Norovirus_and/or_Norovirus-like__KT962982
augaagauggccagcaacgacgcugcccccuccaaugauggcgcggcugggcuggugccugagaucaacaccgaaacacucccgcuggagcccgucgccggagccgcuauugccgcuccuguuacgggccagaauaacaucauugaccccuggaucagaaauaacuucgugcaagccccuaauggggaauuuaccgugucuccccggaacagcccuggagagauucuuaugaaucuggaacucggcccggaucugaaccccuaccuugcgcaccugucccgcauguauaauggguacgccggaggcgucgaggugcagguucuccuggcuggcaacgccuucacagcugggaaaauccuguuugccgcggugccucccaauuucccugucgacaugcucucucccgcccagaucaccaugcugccgcaucuuauuguggauguuagaacacuggagccuaucaugauuccccucccugacgugcggaacgucuuuuaucacuucaauaaccagcccgcuccccgcaugagacugguggccaugcuuuacaccccucugcggagcaacggauccggcgaugacguguuuacagucucuugccgcguucucaccagaccgacgcccgauuucgaauuuaccuaucuggugccucccagcguggaguccaagacaaaaccuuucacccugcccauccucacaauuggggaacugaccaauagccgguuuccggcuccuaucgaccaacuuuacacgucucccaacgccgaugucgugguucagccucagaauggacgcuguacacuggacggcgagcuccaggggaccacacaacugcuuaccaccgccauuugcuccuauaagggaacaacgagcaaccccaccucugauuacugggacgaccaucugcuccaccuggugcauccuaauggcgcuacauacgaucccaccgaggacgucccggcgccuuucggcacacaggauuuuagagggauccuguauggagugcucacccagaacacgcagaauccccgggacgaaguuuccaacagccgcggcaucuacauuucuuccacaagcgauaaauucacccccaagcuggggaccaucggacuucaccaagugcagggcgacacagccuccaaucagcaaucuaaguucaccccugucgggauugcugugaaccagaauacaccguuuaaacagugggagcugcccaacuauagcggagcccucacgcugaauaccaaccuugccccugcugucggccccaauuucccuggcgaacagauccuguuuuucagauccaacgugcccagcguucaagggaaccacccuacacaggagauugauugucucaucccccaggaaugggugucucauuuuuaccaggaguccgccccgagccaaucugacgucgcgcuggugcgguauguuaauccugauaccggacgcacaaucuucgaggcuaagcugcacagacagggcuuuauuaccaucgccgccacggggagcaaccccguggucgugccucccaauggauacuuccgguuugacuccugggugaaccaguucuaugcucucgccccgaugggcaccgggaauggcagacgccgggcucaguga

SEQ ID NO: 28998 - RNA, 1623 nt, Artificial Sequence
  derived and/or modified sequence opt5 from VP1__Norovirus_and/or_Norovirus-like__KX079488
augaagauggccagcaacgacgcugcccccuccaaugauggcgcggcugggcuggugccugagaucaacaccgaaacacucccgcuggagcccgucgccggagccgcuauugccgcuccuguuacgggccagaauaacaucauugaccccuggaucagaaauaacuucgugcaagccccuaauggggaauuuaccgugucuccccggaacagcccuggagagauucuuaugaaucuggaacucggcccggaucugaaccccuaccuugcgcaccugucccgcauguauaauggguacgccggaggcgucgaggugcagguucuccuggcuggcaacgccuucacagcugggaaaauccuguuugccgcggugccucccaauuucccugucgacaugcucucucccgcccagaucaccaugcugccgcaucuuauuguggauguuagaacacuggagccuaucaugauuccccucccugacgugcggaacgucuuuuaucacuucaauaaccagcccgcuccccgcaugagacugguggccaugcuuuacaccccucugcggagcaacggauccggcgaugacguguuuacagucucuugccgcguucucaccagaccgacgcccgauuucgaauuuaccuaucuggugccucccagcguggaguccaagacaaaaccuuucacccugcccauccucacaauuggggaacugaccaauagccgguuuccggcuccuaucgaccaacuuuacacgucucccaacgccgaugucgugguucagccucagaauggacgcuguacacuggacggcgagcuccaggggaccacacaacugcuuaccaccgccauuugcuccuauagaggaacaacgagcaaccccaccucugauuacugggacgaccaucugcuccaccuggugcauccuaauggcgcuacauacgaucccaccgaggacgucccggcgccuuucggcacacaggauuuucgggggauccuguauggagugcucacccagaacacgcagaauccccgcgacgaaguuuccaacagcagaggcaucuacauuucuuccacaagcgauaaguucacccccaaacuggggaccaucggacuucaccaagugcagggcgacacagccuccaaucagcaaucuaaguucaccccugucgggauugcugugaaccagaauacaccguuuaagcagugggagcugcccaacuauagcggagcccucacgcugaauaccaaccuugccccugcugucggccccaauuucccuggcgaacagauccuguuuuuccgguccaacgugcccagcguucaagggaaccacccuacacaggagauugauugucucaucccccaggaaugggugucucauuuuuaccaggaguccgccccgagccaaucugacgucgcgcuggugcgcuauguuaauccugauaccggaagaacaaucuucgaggcuaaacugcaccggcagggcuuuauuaccaucgccgccacggggagcaaccccguggucgugccucccaauggauacuucagauuugacuccugggugaaccaguucuaugcucucgccccgaugggcaccgggaauggccgccggagagcucaguga

SEQ ID NO: 28999 - RNA, 1623 nt, Artificial Sequence
  derived and/or modified sequence opt5 from VP1__Norovirus_and/or_Norovirus-like__KR921938
augaagauggccagcaacgacgcugcccccuccaaugauggcgcggcugggcuggugccugagaucaacaccgaaacacucccgcuggagcccgucgccggagccgcuauugccgcuccuguuacgggccagaauaacaucauugaccccuggaucagaaauaacuucgugcaagccccuaauggggaauuuaccgugucuccccggaacagcccuggagagauucuuaugaaucuggaacucggcccggaucugaaccccuaccuugcgcaccugucccgcauguauaauggguacgccggaggcgucgaggugcagguucuccuggcuggcaacgccuucacagcugggaaaauccuguuugccgcggugccucccaauuucccugucgacaugcucucucccgcccagaucaccaugcugccgcaucuuauuguggauguuagaacacuggagccuaucaugauuccccucccugacgugcggaacgucuuuuaucacuucaauaaccagcccgcuccccgcaugagacugguggccaugcuuuacaccccucugcggagcaacggauccggcgaugacguguuuacagucucuugccgcguucucaccagaccgacgcccgauuucgaauuuaccuaucuggugccucccagcguggaguccaagacaaaaccuuucacccugcccauccucacaauuggggaacugaccaauagccgguuuccggcuccuaucgaccaacuuuacacgucucccaacgccgaugucgugguucagccucagaauggacgcuguacacuggacggcgagcuccaggggaccacacaacugcuuaccaccgccauuugcuccuauagaggaacaacgagcaaccccaccucugauuacugggacgaccaucugcuccaccuggugcauccuaauggcgcuacauacgaucccaccgaggacgucccggcgccuuucggcacacaggauuuucgggggauccuguauggagugcucacccagaacacgcagaauccccgcgacgaaguuuccaacagcagaggcaucuacauuucuuccacaagcgauaaguucacccccaaacuggggaccaucggacuucaccaagugcagggcgacacagccuccaaucagcaaucuaaguucaccccugucgggauugcugugaaccagaauacaccguuuaagcagugggagcugcccaacuauagcggagcccucacgcugaauaccaaccuugccccugcugucggccccaauuucccuggcgaacagauccuguuuuuccgguccaacgugcccagcguucaagggaaccacccuacacaggagauugauugucucaucccccaggaauggaucucucauuuuuaccaggaguccgccccgagccaaucugacguggcgcugguccgcuaugugaauccugauaccggaagaacaauuuucgaggcuaaacugcaccggcagggcuuuaucaccauugccgccacggggagcaaccccguuguggucccucccaauggauacuucagauuugacuccugggugaaccaguucuaugcucucgccccgaugggcaccgggaauggccgccggagagcucaguga

SEQ ID NO: 29000 - RNA, 1623 nt, Artificial Sequence
  derived and/or modified sequence opt5 from VP1__Norovirus_and/or_Norovirus-like__KR921940
augaagauggccagcaacgacgcugcccccuccaaugauggcgcggcugggcuggugccugagaucaacaccgaaacacucccgcuggagcccgucgccggagccgcuauugccgcuccuguuacgggccagaauaacaucauugaccccuggaucagaaauaacuucgugcaagccccuaauggggaauuuaccgugucuccccggaacagcccuggagagauucuuaugaaucuggaacucggcccggaucugaaccccuaccuugcgcaccugucccgcauguauaauggguacgccggaggcgucgaggugcagguucuccuggcuggcaacgccuucacagcugggaaaauccuguuugccgcggugccucccaauuucccugucgacaugcucucucccgcccagaucaccaugcugccgcaucuuauuguggauguuagaacacuggagccuaucaugauuccccucccugacgugcggaacgucuuuuaucacuucaauaaccagcccgcuccccgcaugagacugguggccaugcuuuacaccccucugcggagcaacggauccggcgaugacguguuuacagucucuugccgcguucucaccagaccgacgcccgauuucgaauuuaccuaucuggugccucccagcguggaguccaagacaaaaccuuucacccugcccauccucacaauuggggaacugaccaauagccgguuuccggcuccuaucgaccaacuuuacacgucucccaacgccgaugucgugguucagccucagaauggacgcuguacacuggacggcgagcuccaggggaccacacaacugcuuaccaccgccauuugcuccuauagaggaacaacgagcaaccccaccucugauuacugggacgaccaucugcuccaccuggugcauccuaauggcgcuacauacgaucccaccgaggacgucccggcgccuuucggcacacaggauuuucgggggauccuguauggagugcucacccagaacacgcagaauccccgcgacgaaguuuccaacagcagaggcaucuacauuucuuccacaagcgauaaguucacccccaaacuggggaccaucggacuucaccaagugcagggcgacacagccuccaaucagcaaucuaaguucaccccugucgggauugcugugaaccagaauacaccguuuaagcagugggagcugcccaacuauagcggagcccucacgcugaauaccaaccuugccccugcugucggccccaauuucccuggcgaacagauccuguuuuuccgguccaacgugcccagcguucaagggaaccacccuacacaggagauugauugucucaucccccaggaaugggugucucauuuuuaccaggaguccgccccgagccaaucugacgucgcgcuggugcgcuauguuaauccugauaccggaagaacaaccuucgaggcuaaacugcaccggcagggcuuuaucacgauugccgccaccgggagcaaccccguggucgugccucccaauggauacuucagauuugacuccugggugaaccaguucuaugcucucgccccgaugggcacagggaauggccgccggagagcucaguga

SEQ ID NO: 29001 - RNA, 1623 nt, Artificial Sequence
  derived and/or modified sequence opt5 from VP1__Norovirus_and/or_Norovirus-like__DQ358209
augaagauggccagcaacgacgcugcccccuccaaugauggcgcggcugggcuggugccugaaaucaacaaugaagucaugccgcucgagcccguugccggagccucucuggcuaccccuguggugggccagcaaaacauuaucgaccccuggauuagaaauaacuucguccaggccccugcuggggaauuuacagugagcccccgcaauuccccuggagagauccuucuggaucucgaacugggcccggagcuuaaccccuaccuggcccaccucgcgcggauguauaaugggcaugccggaggcauggagguucagauugugcuggcuggcaacgccuucacggcugggaaaaucgucuuugccgcgaucccucccggauucccuuacgaaaaucugucucccagccagauuaccaugugcccgcacgugaucauugacguuagacaacucgagccugugcugcuucugaugcccgauaucaagaacaacuuuuuccauuauaaucagggcaaugacccuaaacuccggcuggucgccaugcuuuacacaccccugcgcgcuaacaacuccggggaugacguguuuaccgugucuuguagaguccucacaaagcccagcccugauuucgaauuuaccuuccugguuccgcccacaguggaguccaaaaccaagcaguuuacgcugccuauucucaagaucagcgagaugaccaauucucgguuccccgugccugucgaaaugauguauacagcccgcaacgagaaucaggugguucaaccccagaacggaagagugacccuggacggcgaacuucuggggacaaccccgcuccuggcugucaauauuugcaaauuuaagggagaggugaucgccaaaaacggcgauguucgguccuaccgcauggacauggaaaucacgaauacagauggcaccccuauugaccccacagaggacaccccugggcccaucggaagcccugauuuccagggcauucuuuucgggguggccucucagagaaacaagaaugagcaaaaccccgcuacccgggcgcaggaagucaauaucaacacaggaggcgaccaguaugccccgaaacuggcucaagugaaguuuuucuccgagagccaggauuuugaaguccaccagccuacgguguucacccccguugggguggccggagaccccucucauccuuuucgccaguggacacucccgagauacggcggccaccugaccaauaacauucaccuggcccccgcugucgccccucucuuccccggggagcaaauccuguuuuuccggucccagaucccuagcuccggaggccaugaacuuggguacauggauugucuggugccccaggaguggguucagcacuuuuaucaagaggcggcuacagcccagucugaaguggcccucauucgcuucaucaauccugacaccggaagaguccuguuugaggcuaaacuucauaagcagggcuucauuacgguggcccacacaggggauaaccccaucgugaugccgccuaacggcuacuuucgguucgaggcuuggguuaaucaguucuauagccuggcccccgucggaaccggcaacgggagacgccgggugcaauga

SEQ ID NO: 29002 - RNA, 1623 nt, Artificial Sequence
  derived and/or modified sequence opt5 from VP1__Norovirus_and/or_Norovirus-like__KP784694
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcugacccucccaauuuuccuacggagggacugucccccucucagguuaccauguucccgcauaucauuguggaugucagacaacucgagccugugcugaucccccugccugacgugcggaacaauuuuuaucacuacaaccagagcaaugaucccacaauuaagcucaucgccaugcuguauacaccccuucgcgcuaacaacgccggcgacgaugucuucaccguuuccugcagagugcugacccggccuagcccggacuuugauuucauuuuucucgugcccccuacagucgaaucucgcaccaaacccuucuccgugccuauccugacgguugaggaaaugaccaauagcagauuucccauuccgcuugagaagcuguucacagggccuucuuccgccuucgugguccagccccagaacggacgguguaccacagacggcgugcuccuggggaccacgcaacugagcccuguuaauaucugcacauuucgcggagaugugacccauaucgcuggcucucacaacuacacaaugaaucucgcgacccagaacuggaacuccuaugaccccaccgaggaaauuccugcuccccugggcacaccggacuucgucgggaaaauccagggagugcuuacgcagaccacaaagaccgauggcagcacaagaucccauaaggccaccgucuacacggggucugccgacuuugccccuaaacugggacgggugcaauucgagacagauaccaauaaugacuuugaaaccaaccagaauacaaaguucacccccguuggcgugauucagaacggggagacagcucaccgcaaugaaccccaacaguggguccucccuagcuacuccggaagaaacacgccgaaugugcaccuggcccccgcgguugcuccuaccuuucccggcgagcagcuucuguucuuucggagcacaaugccuggcuguucuggguaucccaacauggaucucgacugccugcugccucaggagugggugcaauacuucuaucaggaagccgcccccgcucaguccgaugucgcccuccugcgcuuugugaacccggacaccggaagagugcuuuucgaguguaaacugcauaagagcggcuacguuacagucgcucacaccgggucucaugaucucgugaucccucccaauggauauuuucgguucgacagcugggugaaccaguucuacacgcuggccccuaugggcaaugggaccggcagacgccgggcgacauga

SEQ ID NO: 29003 - RNA, 1623 nt, Artificial Sequence
  derived and/or modified sequence opt5 from VP1__Norovirus_and/or_Norovirus-like__KX354064
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaucuaccacacaccggaaugagccccaacaguggguccucccuagcuacuccggccgcaacacgcacaaugugcaucuggcuccggccguggcgcccaccuuuccuggcgaacagcuucuguucuuuagaagcacaaugcccggguguucuggauauccuaacauggaccucgauugccugcugccccaggaguggguucaauacuucuaucaggaggcugccccugcccaguccgacgucgcucuccugcgguuugugaaucccgauaccggcagagugcuuuucgaauguaagcugcacaaaagcggguacgucacaguggcccauaccggacagcacgaccucguuauuccgccuaacggcuauuuucgcuucgauucuugggugaaccaauucuacacgcuggcucccauggggaauggcaccggacggagacgcgccauguga

SEQ ID NO: 29004 - RNA, 1623 nt, Artificial Sequence
  derived and/or modified sequence opt5 from VP1__Norovirus_and/or_Norovirus-like__LC177658
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcgccccggacuucguugggaaaauccagggaaugcuuacacagacgacccgggcugacggcagcacacgcgggcacaaggccaccguguacacaggauccgccgauuuugcuccuaagcugggcagaguccaauucgagaccgacacggaucaugacuuugaagccaaucagaacacaaaauucacccccguggggguuauccaggauggaggcaccacacaccggaaugagccccaacagugggugcucccuucuuacagcggccgcaacacccacaauguccaucuggcgccggcuguggcccccacauuuccuggggaacagcuucuguucuuuagauccacgaugcccggauguagcggcuauccuaacauggaccucgauugccugcugccccaggagugggugcaauacuucuaucaggaggccgcuccugcccagucugacguugcucuccugcgguuugucaaucccgauaccgggagagugcuuuucgaauguaagcugcacaaauccggauacgugacagucgcccauaccggccagcacgaccucgugauuccgccuaacggguauuuucgcuucgauagcuggguuaaccaauucuacacacuggcgcccaugggcaauggagccggccggagacgcguggcuuga

SEQ ID NO: 29005 - RNA, 1623 nt, Artificial Sequence
  derived and/or modified sequence opt5 from VP1__Norovirus_and/or_Norovirus-like__KX514232
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgacacaaccaacgaucucgacgcccaucaaaauacgaaauucacacccgucggggugguucagggaggcgaaagcccucagcgguccgagccgcaacagugggugcugcccagcuauucuggccgcgauaccccuaacguccaccuugcucccgccguggcgccuaccuuucccggggaacagcuccuguucuuuagauccacaaucccuggauguggcgggcaccccaauaugaaccuggacugccugcucccgcaggagugggugcaacauuucuaccaggaggcugccccugcccagagcgauguugcucugcuucgguuugucaaucccgacaccucuagagugcuguucgaauguaagcuccacaaaagcggauaugugacagucgcccauacgggccagcacgaucuggugauuccucccaacggguacuuucgcuucgacuccuggguuaaccaauuuuauacccuugcuccgaugggcaauggaacaggccggaagagagccucuuga

SEQ ID NO: 29006 - RNA, 1623 nt, Artificial Sequence
  derived and/or modified sequence opt5 from VP1__Norovirus_and/or_Norovirus-like__LC145787
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucccuguuuccauugaucagauguacaccagccccaacgaggugaucucuguccagugucagaacggacggugcacgcuugacggcgaacugcaagggacaacccagcuccagguguccggaauuugugccuuuaagggcgagguuacagcucaucugcacgauaaugaccaccuuuauaacgugaccaucaccaaucugaacggcagcccguucgacccuucugaagauguccccgcgccucucggggugcccgacuuccagggacgcgucuuuggcauuaucucccaaagagauaagcacaauagcccugggcauaacgagcccgccaaucggggacacgacgcugugguuccgacauacacggcccaguacaccccuaaacugggccagauucaaaucgggacauggcagaccgaugaccugacagugaaccagcccgucaaguucacccccgugggacucaaugauacggaacauuuuaaccaguggguugugccucgcuaugccggcgcucugaaucuuaacacaaaucuggccccguccgucgcgcccguguucccuggcgagagacuccuguuuuuccggucuuacgugccccuuaaagggggauauggcaacccugcuaucgacugccugcucccccaagaguggguucagcacuuuuaccaggaagccgccccuagcauguccgaggucgcucuggugcgcuauauuaaucccgauaccgggagagcccuguucgaagcuaagcuccaccgggccggauuuaugaccgugagcucuaacacauccgcgccggucgugguuccugccaacggcuacuucagauuugacagcugggugaaucaguucuauucucuggcucccauggggaccggcaacggacgccggagauga

SEQ ID NO: 29007 - RNA, 1623 nt, Artificial Sequence
  derived and/or modified sequence opt5 from VP1__Norovirus_and/or_Norovirus-like__KT962983
augaagauggccagcaacgacgcugcccccuccaccgauggcgcggcugggcuggugccugagucuaauacagaagucauggcccucgagccgguugccggagcugcccuggcugcccccgugacgggccagaccaacaucauugacccuuggaucagagcgaauuucgugcaagcccccaacggggaauuuacagucagcccucggaaugcucccggagaggugcuucugaaccucgaacugggcccugagcuuaauccguaccuggcccaccucgcucgcauguauaacggguacgccggaggcauggagguucaggugaugcuggcgggcaaugccuucaccgcugggaaacuggucuuugccgcugugcccccucauuuccccguugaaaaccucuccccucagcagauuacaauguuuccccacgugaucauugaugucagaacccuggagccggugcuucugccucuccccgacgugcggaauaacuucuuucauuauaaucaaaaggaugacccuaaaaugcgcaucgucgccaugcuguacacaccccuuagaucuaacggaagcggcgaugacguuuucaccguguccugccgggugcugacgcgccccucuccugauuuugacuucaccuaucucgucccgcccacaguggaaagcaagaccaaaccuuuuacacugcccauccugacccucggggagcuguccaauagcagauucccuguuucuauugaucagauguacacgucccccaacgaggugaucagcguccagugucagaacggacggugcacacuugacggcgaacugcaagggaccacacagcuccaggugucuggaauuugugccuuuaagggcgagguuaccgcucaucugcacgauaaugaccaccuuuauaacaucaccauuacaaaucugaacggcuccccguucgacccuagcgaagauauccccgcgccucucggggugcccgacuuccagggacgcgucuuuggcauuaucucucaaagagauaagcacaauuccccugggcauaacgagcccgccaaucggggacacgacgcuguggucccgacguacaccgcccaguacacaccuaaacugggccagauccaaauugggaccuggcagacagaugaccugaccgugaaccagcccguuaaguucacgcccgugggacucaaugauacagaacauuuuaaccagugggucgugccucgcuaugccggcgcucugaaucuuaacaccaaucuggccccgagcguugcgcccguguucccuggcgagagacuccuguuuuuccgguccuacaucccccuuaaagggggauauggcaacccugcuauugacugccugcucccccaagaguggguccagcacuuuuaccaggaagccgccccuucuaugagcgagguggcucuggugcgcuauaucaaucccgauaccgggagagcccuguucgaagcuaagcuccaccgggccggauuuaugacaguuuccagcaacaccucugcgccggucguggugccugccaacggcuacuucagauuugacuccugggucaaucaguucuauagccuggcucccauggggacaggcaacggacgccggagauga

SEQ ID NO: 29008 - RNA, 1623 nt, Artificial Sequence
  derived and/or modified sequence opt5 from VP1__Norovirus_and/or_Norovirus-like__AB629946
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucaccguuuccauugaucagauguacacgagccuuaacgaggugaucucuguccagugucagaacggacggugcacacuggacggcgaacuccgcgggaccacacaacuucagguguccggaauuugugccuuuaagggcgagguuaccgcucacgugcaugauaaugaccaccuguauaacgucaccaucacaaaucugaacggcagcccuuucgaccccucugaagaugugccggcgccucucgggguccccgacuuccagggaagaguguuuggcauuaucucccagcgggauaagcacaauagcccugggcauaacgagcccgccaaucgcggacacgacgcuguugugccuacguacaccgcccaauacacacccaaacugggccagauucagaucgggaccuggcaaacagaugaccugaccgucaaccagccggugaaguucacgccuguuggacucaaugauacagaacauuuuaaccagugggugguccccagauaugccggcgcucugaaucuuaacaccaaucuggcccccuccguggcgccuguguucccgggcgagcggcuccuguuuuuccgcucuuacguuccccuuaaagggggauauggcaacccugcuaucgacugccugcucccccaggaguggguccaacacuuuuaccaggaagccgccccuagcauguccgagguggcucuggugagauauauuaaucccgauaccgggcgggcccuguucgaagcuaagcuccacagagccggauuuaugacagucagcucuaacaccuccgcgccugugguugugcccgccaacggcuacuuccgcuuugacagcugggucaaucaguucuauucucuggcuccgauggggacaggcaacggacggagacgcuga

SEQ ID NO: 29009 - RNA, 1623 nt, Artificial Sequence
  derived and/or modified sequence opt5 from VP1__Norovirus_and/or_Norovirus-like__AB809993
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccgcggacaggacgccuucaucgauugucugcugccucaggaaugggucaaucacuuuuaccaagaggcugcccccucucaggcugacguggcccucauuagauauguuaacccugauacaggccggacccuguucgaagcgaaacuucacagaagcggguuuaucacagugucccauacgggagccuacccccuggucgugccgccuaacggccacuuccgcuuugacucuugggugaaucaguucuauagccucgcucccauggggaccggcaacggacggagacgcuga

SEQ ID NO: 29010 - RNA, 1623 nt, Artificial Sequence
  derived and/or modified sequence opt5 from VP1__Norovirus_and/or_Norovirus-like__JQ743330
augaugauggccagcaaggacgcucccccuaacauggauggcaccuccggggccggacagcuggugccggaggcgaauacagcugaacccaucucuauggagccugucgccggcgccgcuacggccgcugccaccgcggggcaaguuaacaugauugaccccuggaucaugaauaacuacgugcaggccccucagggagaguucacaauuagccccaauaacaccccuggcgauauccucuuugaccugcagcuugggccgcaccugaaucccuuccucucccaucuggcucaaauguauaacggaugggugggcaauaugaaagucaaggugcuucuggccggcaacgcuuuuacagccgggaaaauuaucaucucuugcauuccucccggauucgcggcccagaauaucagcauugcucaggccaccauguuuccucacguuaucgcugaugugagaguccucgaacccauugaagugccgcuggaggacguucggaacgugcuguuccauaauaacgauaauacaccuaccaugcgccucgucuguaugcuguacacgccccuuagagccuccggcucuagcuccgggaccgacccuuuugugaucgccggacgggugcugacaugccccagccccgauuucucuuuucucuuccuggucccuccgaacguugagcagaagaccaaacccuuuuccgugccuaaccuuccccugaauacacucagcaacucucgcgugccuucccugauuagaagcaugauggucucucgggaccacggccaaauggugcaguuccagaaugggcgcguuacccuggauggacagcuccaaggcacgacacccaccuccgcuagccagcuguguaagaucagaggcuccguguuucaugcgaacgggggaaauggcuauaaccuuacagaacuggacgggucuccguaccacgccuucgagagcccugcucccaucggauucccugaucucggcgaaugcgacuggcacauggaggccucccccaccacccaguuugacacaggggaugucauuaagcaaaucaaugugaaacaggaggccgcuuucgccccucaucugggaacgauucaggcggacggccuuagcgauguuucugugaacaccaauaugaucgcuaagcugggcugggucucccccgugagcgacgggcaccggggaucugucgauccgugggugauuccucgcuauggcagcacacucaccgaagccgcccagcuggcuccucccaucuaucccccgggguuuggagaggccaucguuuucuuuauguccgacuuccccauugcucauggcgccaacgggcugucugugccuuguacaaucccccaagaauuugucacccacuucgugaaugagcaggcgccuacgagaggcgaagccgcucuccugcacuaccuugaucccgacacacaucggaaccugggagaguuuaaacucuacccugagggcuucaugaccugcguucccaauagcuccgggaccggaccgcagacacugccuauuaacggcguguuugccuucgucagcugggugucucgcuuuuaccagcuuaagcccguggggaccgcuggaccugccagacggcuguga

SEQ ID NO: 29011 - RNA, 1623 nt, Artificial Sequence
  derived and/or modified sequence opt5 from VP1__Norovirus_and/or_Norovirus-like__AF439267
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgauauccucuuugaccugcagcuugggccucaccugaauccguuccucucccaucuggcccaaauguauaacggaugggugggcaauaugaaagucaaggugcuucuggccggcaacgcuuuuaccgccgggaaaauuaucaucucuugcauucccccuggauucgcggcccagaauaucagcauugcucaggccacaauguuuccccacguuaucgcugaugugagaguccucgaaccuauugaagugccccuggaggacguucggaacgugcuguuccauaauaacgauaauaccccgacgaugcgccucgucuguaugcuguacaccccucuuagagccuccggcucuagcuccgggacagaccccuuugugaucgccggacgggugcugaccugcccuagccccgauuucucuuuucucuuccugguucccccuaacgucgagcagaagacaaaaccguuuuccgugcccaaccuuccucugaauacccucagcaacucucgcgugcccucccugauuaagagcaugauggucucuagagaccacggccaaauggugcaguuccagaaugggcggguuacgcuggauggacagcuccaaggcacaaccccuacauccgcuagccagcuguguaagauccgcggcuccguguuucaugcgaacgggggaaauggcuauaaccuuaccgaacuggacgggucucccuaccacgccuucgagagcccggcuccugucggauuccccgaucucggcgaaugcgacuggcacauggaggccuccccuaccacacaguuuaauacgggggacgugaucaaacaaauuaacguuaagcaggagagcgccuucgcuccccaucugggaaccauccaggccgauggccuuucugacguguccgucaauacaaacaugauugcgaaacugggcugggugagcccugucucugaugggcacaagggagacguggaucccuggguuaucccgagauauggcagcacccucacagaagcugcccagcuggccccucccauuuaucccccuggguuuggagaggcuaucguguucuuuauguccgacuucccgaucgcccauggcaccaaugggcugucuguccccuguacgauuccucaagaauuugugacacacuucguuaacgagcaggcucccacccggggcgaagccgcgcuccugcacuaccuugauccugacacccaucgcaaucugggagaguuuaaacucuaccccgauggcuucaugacaugcgugccuaacagcuccgggaccggaccccagacacugccgaucaauggcgucuuuguguucgugagcuggguuucuagauuuuaccagcuuaagccugucgggacggccggacccgcucggcgccuguga

SEQ ID NO: 29012 - RNA, 1623 nt, Artificial Sequence
  derived and/or modified sequence opt5 from VP1__Norovirus_and/or_Norovirus-like__EF547393
augaugauggccagcaagggcgcucccaccaacauggacgggacauccggagccggccagcuggugccugaggcgaauacggcugaaccgaucucuauggagcccgucgccggggccgcuaccgccgcugccacagcgggacaaguuaacaugauugauccuuggaucaugaauaacuacgugcaggcuccccagggcgaguucaccauuagcccuaauaacacacccggggacauccucuuugaucugcagcuuggaccucaccugaauccguuccucucccaucuggcccaaauguauaacggcugggugggcaauaugaaagucaaggugcuucuggccgggaacgcuuuuaccgccggaaaaauuaucaucucuugcauucccccuggcuucguugcgcagaauaucagcauugcccaggcuacaauguuuccccacgugaucgccgacgucagagugcucgaaccuauugaaguuccccuggaggaugugcggaacguccuguuccauaauaacgacaauaccccgacgaugcgccucguguguaugcuguacaccccucuuagagcuuccgggucuagcuccggaacagaucccuuugugaucgccggccggguccugaccugcccuagccccgacuucucuuuucucuuccugguucccccuaacguggagcagaagacaaaaccguuuuccgugcccaaccuuccucugaauacccucagcaacucucgcguccccucccugauuaagagcaugauggugucuagagaucacgggcaaaugguucaguuccagaauggacgggugacgcuggacggccagcuccaaggcacaaccccuacauccgccagccagcuguguaagauccgcggguccgucuuucaugcuaacggaggcaauggguauaaccuuaccgaacuggauggaucucccuaccacgcguucgagagcccggccccuaucggcuuccccgaccucggggaaugcgauuggcacauggaggcuuccccuaccacacaguuuaauacgggagacgugauuaaacaaaucaacguuaagcaggagagcgccuucgcuccccaucugggcaccauucaggccgacggccuuucugauguguccgucaauacaaacaugaucgccaaacuggaaugggugagcccugucucugacgggcacaagggagauguggaccccuggguuauuccgagauauggcagcacccucacagaggcggcucagcuggccccucccaucuaucccccuggguuuggagaagccaucguguucuuuauguccgauuucccgauugcucauggcaccaaugggcugucuguccccuguacgaucccucaagaguuugugacacacuucguuaacgaacaggcccccacccggggcgaggcugcccuccugcacuaccuugacccugauacccaucgcaaucugggagaguuuaaacucuaccccgacggcuucaugacaugcgugccuaacagcuccgggaccggaccccagacacugccgauuaauggcgucuuuguguucgugagcuggguuucuagauuuuaccagcuuaagccugucgggacggcgggacccgcccggcgccuguga

SEQ ID NO: 29013 - RNA, 1623 nt, Artificial Sequence
  derived and/or modified sequence opt5 from VP1__Norovirus_and/or_Norovirus-like__AF145709
augaugauggccagcaaggacgcucccccuaacauggauggcaccuccggggccggacagcugaucccggaggcgaauacagcugaacccauuucuauggagccuguggccggcgccgcuacggccgcugccaccgcggggcaagucaacaugaucgaccccuggauuaugaauaacuacguucaggccccucagggagaguucacaaucagccccaauaacaccccuggcgauauucucuuugaccugcagcuugggccgcaccugaaucccuuccucucccaucuggcucaaauguauaacggaugggugggcaauaugaaaaugaaggugcuucuggccggcaacgcuuuuacagccgggaaaaucaucauuucuugcaucccucccggauucgcggcccagaauauuagcaucgcucaggccaccauguuuccucacgucauugcugaugugagaguucucgaacccaucgaagugccgcuggaggacguccggaacgugcuguuccauaauaacgauaauacaccuaccaugcgccucguuuguaugcuguacacgccccuuagagccuccggcucuagcuccgggaccgacccuuuugugauugccggacggguccugacaugccccagccccgauuucucuuuucucuuccuggugccuccgaacguggagcagaagaccaaacccuuuuccgucccuaaccuuccccugaauacacucagcaacucucgcguuccuucccugaucaagagcaugauggugucuagagaccacggccaaauggugcaguuccagaaugggcgggucacccuggauggacagcuccaaggcacgacacccaccuccgcuagccagcuguguaagauccgcggcuccguguuucaugcgaacgggggaaauggcuauaaccuuacagcccuggacgggucuccguaccacgcuuucgaaagcccugcccccauuggauucccugaucucggcgagugcgacuggcacauggaagccucccccaccacccaguuugacacaggggauguuaucaaacaaauuaaugugaagcaggagagcgcuuucgccccucaucugggaacgauccaggcggacggccuuucugaugucuccgugaacaccaauaugauugcuaaacugggcuggguuagccccgugucugacgggcacagaggaaacgucgauccgugggugaucccucgguauggcagcacacucaccgaggccgcccagcuggcuccucccaucuaucccccgggguuuggagaagccauugucuucuuuauguccgacuucucuaucgcucauggcacaaaugggcugagcgugcccuguaccauuccucaagaguuuguuacgcacuucgugaacgaacaggcccccacacgcggcgaggcggcccuccugcacuaccuugauccugacacccauagaaaucugggagaauuuaagcucuaccccgagggcuucaugaccugcgucccuaacuccagcgggacaggaccccagacccugccgaucaauggcguguuuguuuucgugucuugggucucccgguuuuaccagcuuaaaccuguggggacagcuggacccgcccgcagacuguga

SEQ ID NO: 29014 - RNA, 1623 nt, Artificial Sequence
  derived and/or modified sequence opt5 from VP1__Norovirus_and/or_Norovirus-like__FJ711163
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaauuuaccauuagcccuaauaacacacccggcgaugugcucuuugaccugcagcuugggccucaccugaauccguuccucucccaucuggcccaaauguauaacggaugggucggcaauaugaaagugaagguucuucuggccggcaacgcuuuuaccgccgggaaaaucauuaucucuugcauucccccuggauucgcggcccagaauuuuagcaucgcucaggccacaauguucccccacgugaucgcugaugucagagugcucgagccuauugaaguuccccuggaggacgugcggaacguccuguuucauaauaacgauaauaccccgacgaugcgccucguguguaugcuguacaccccucuuagagccuccggcucuagcuccgggacagaccccuucgugaucgccggacggguccugaccugcccuagccccgauuuuucuuuccucuuucugguucccccuaacguggagcagaagacaaaaccguucuccgugcccaaccuuccucugaauacccucagcaacucucgcguccccucccugauuaagagcaugaugaucucuagagaccacggccaaauggugcaguuucagaaugggcggguuacgcuggauggacagcuccaaggcacaaccccuacauccgcuagccagcuguguaagauucgcggcuccguguuccaugcgaacgggggaaauggcuauaaccuuaccgaacuggacgggucucccuaccacgccuucgagagcccggcuccuaucggauuucccgaucucggcgaaugcgacuggcacauggaggccuccccuaucacccaguucgacacaggggaugucauuaaacaaaucaaugugaagcaggagagcgccuuugcuccccaucugggaacgguucaggccgacggccuuucugauguguccgcgaacaccaauaugauugcuaaacugggcugggucagcccugugucugacgggcacagaagcgaugucgaccccugggugaucccgcgguauggauccacacucaccgaagccgcccagcuggcuccucccauuuaucccccuggcuucggggaggccaucguuuucuucaugucugauuuuccgaucgcucauggaacaaacggccugagcgugcccuguaccauuccucaagaguucgucacgcacuuugugaaugaacaggcccccacacgcggggaagcggcccuccugcacuaccuugacccugauacccauagaaaccugggcgaguucaagcucuaccccgacggauuuaugaccugcguuccuaauuccagcggcacagggccccagacccugccgaucaacggaguguucgucuuugugucuugggugucccgguucuaccagcuuaaaccuguuggcacagcugggcccgcccgcagacuguga

SEQ ID NO: 29015 - RNA, 1623 nt, Artificial Sequence
  derived and/or modified sequence opt5 from VP1__Norovirus_and/or_Norovirus-like__FJ711164
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgaugugcucuuugaccugcagcuugggccucaccugaauccguuccucucccaucuggcccaaauguauaacggaugggucggcaauaugaaagugaagguucuucuggccggcaacgcuuuuaccgccgggaaaaucauuaucucuugcauucccccuggauucguggcgcagaauuuuagcaucgcccaggcuacaauguucccccacgucaucgccgaugugagaguucucgaaccuauugaagugccccuggaggacguccggaacgugcuguuucauaauaacgauaauaccccgacgaugcgccucguguguaugcuguacaccccucuuagagcuggcggguccucuagcggaacagaccccuucgucaucgccggccggguucugaccugcccuucccccgauuuuagcuuccucuuucuggugcccccuaacguggagcagaagacaaaaccguucucuguccccaaccuuccucugaauacccucuccaacagccgcgugcccucucugauuaaguccaugaugaucagcagagaccacgggcaaaugguucaguuucagaauggacgggugacgcuggauggccagcuccaaggcacaaccccuacaucugccucccagcuguguaagauucgcgggagcgucuuccaugcuaacggaggcaauggguauaaccuuaccgaacuggacggaucccccuaccacgcguucgagucuccggccccuaucggcuuucccgaucucggggaaugcgacuggcacauggaggcuagcccuaccacacaguucgacacgggagaugugaucaaacaaauuaauguuaagcaggaguccgccuuugcuccccaucugggcaccgugcaggccgacggccuuagcgaugucucugccaacacaaauaugaucgcgaaacugggguggguguccccugucagcgacggacacagaucugauguggaccccuggguuauuccgcgguauggcagcacccucacagaagcugcccagcuggccccucccaucuaucccccuggguucggagaggcuauuguguuuuucauguccgauuuuccgaucgcccauggcaccaacgggcugucuguccccuguacgaucccucaagaguucgugacacacuuuguuaaugaacaggcucccacccgcggcgaagccgcgcuccugcacuaccuugacccugauacccauagaaaccugggagaguucaagcucuaccccgacggcuuuaugacaugcgugccuaauagcuccgggaccggaccccagacacugccgauuaacggcgucuucguguuugugagcuggguuucucgguucuaccagcuuaaaccugucgggacggccggacccgcucgcagacuguga

SEQ ID NO: 29016 - RNA, 1623 nt, Artificial Sequence
  derived and/or modified sequence opt5 from VP1__Norovirus_and/or_Norovirus-like__AF414405
augaugauggccagcaaggacgcucccccuaacauggauggcaccuccggggccggacagcuggugccggaggcgaauacagcugaacccaucucuauggagccugucgccggcgccgcuacggccgcugccaccgcggggcaaguuaacaugauugaccccuggaucaugaauaacuacgugcaggccccucagggagaguucacaauuagccccaauaacaccccuggcgauauccucuuugaccugcagcuugggccgcaccugaaucccuuccucucccaucuggcucaaauguauaacggaugggugggcaauaugaaagucaaggugcuucuggccggcaacgcuuuuacagccgggaaaauuaucaucucuugcauuccucccggauucgcggcccagaauaucagcauugcucaggccaccauguuuccucacguuaucgcugaugugagaguccucgaacccauugaagugccgcuggaggacguucggaacgugcuguuccauaauaacgauaauacaccuaccaugcgccucgucuguaugcuguacacgccccuuagagccuccggcucuagcuccgggaccgacccuuuugugaucgccggacgggugcugacaugccccagccccgauuucucuuuucucuuccuggucccuccgaacguugagcagaagaccaaacccuuuuccgugccuaaccuuccccugaauacacucagcaacucucgcgugccuucccugauuaagagcaugauggucucuagagaccacggccaaauggugcaguuccagaaugggcggguuacccuggauggacagcuccaaggcacgacacccaccuccgcuagccagcuguguaagauccgcggcuccguguuucaugcgaacgggggaaauggcuauaaccuuacagaacuggacgggucuccguaccacgccuucgagagcccugcucccaucggauucccugaucucggcgaaugcgacuggcacauggaggccucccccaccacccaguuugacacaggggaugucauuaaacaaaucaaugugaagcaggagagcgccuucgcuccucaucugggaacgauucaggccggcggccuuucugacguuuccgugaacaccaauaugaucgcgaaacuggggugggucagccccgugucugauggacacagaggcaacgucgacccgugggugauuccucgguaugggagcacacucaccgaagcugcccagcuggccccucccaucuaucccccgggauuuggcgaggcuaucguuuucuuuauguccgauuuccccauugcccaugggacaaauggccugucugugccuuuuaccaucccccaagaguucgucacgcacuuugugaacgaacaggcuccuacacgcggagaagccgcgcuccuguacuaccuugaccccgauacccacagaaaucugggcgaguucaagcucuacccugagggguuuaugaccuguguucccaacagcuccggaacaggcccgcagacccugccuauuaaugggguguucgucuuugugagcugggugucucgguucuaucagcuuaaacccguuggaacagccggcccugcucgcagacuguga

SEQ ID NO: 29017 - RNA, 1623 nt, Artificial Sequence
  derived and/or modified sequence opt5 from VP1__Norovirus_and/or_Norovirus-like__AB022679
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaacgggugcucaaccugacagagcuugacggaucucccuucaugggcuucggggcuccugcccccgcuggauuuccugaucugggcuccugcgacuggcacaucgagaugagcaaaauccccaauuccucuacccagaacaauccgauugucacaaacagcgugaagccuaauucccagcaguucgucccccaucucagcucuaucacccuggaugaaaacguguccagcggcggggacuacauuggaacgauccaauggacaucucccccuagcgauuccggcggggccaauaccaacuuuuggaagauuccggacuauggaucuagccuggccgaggcuucccagcucgcgcccgccguuuacccucccggcuucaaugaagugaucgucuauuuuauggcuagcaucccugggcccaaccagucuggcuccccuaaucuggugcccugucuucugccgcaggaguacauuacccacuucaucagcgagcaagccccuauucagggagaagccgcucuccugcacuacguugaucccgacacaaaccgcaaucuuggcgaguuuaaacuguauccugggggauaccugaccugcgugcccaacucuuccagcacaggcccgcagcagcucccucuggauggggucuucguguuugccuccugggugucuagauucuaucaacucaagcccguuggaacggcgggcccugcucgggggcgccuguga

SEQ ID NO: 29018 - RNA, 1623 nt, Artificial Sequence
  derived and/or modified sequence opt5 from VP1__Norovirus_and/or_Norovirus-like__AF414403
augaugauggccagcaaggacgcucccccuaacauggauggcaccuccggggccggacagcuggugccggaggcgaauacagcugaacccaucucuauggagccugucgccggcgccgcuacggccgcugccaccgcggggcaaguuaacaugauugaccccuggaucaugaauaacuacgugcaggccccucagggagaauuuacaauuagccccaauaacaccccuggcgauauccucuuugaccugcagcuugggccgcaccugaaucccuuccucucccaucuggcucaaauguauaacggaugggugggcaauaugaaagucaaggugcuucuggccggcaacgcuuuuacagccgggaaaauuaucaucucuugcauuccucccggauucgcggcccagaauaucagcauugcucaggccaccauguuuccucacguuaucgcugaugugagaguccucgagcccauugaagugccgcuggaggacguucggaacgugcuguuccauaauaacgauaauacaccuaccaugcgccucgucuguaugcuguacacgccccuuagagccuccggcucuagcuccgggaccgacccuuuugugaucgccggacgggugcugacaugccccagccccgauuucucucuccuguuucuugucccuccgaacguugagcagaagaccaaacccuucuccgugccuaaccugccccucaauacacugagcaacucucgcgugccuucccugauuaagagcaugauggucucuagagaccacggccaaauggugcaguuucagaaugggcggguugcucucgauggacagcugcaaggcaccacgcccacauccgcgagccagcuuuguaagauccgcggcuccguguuccaugccaacgggggaaauggcuauaacccgaccgaacuggacgggucuccuuaccacgcuuuugagagccccgccccuaucggauuccccgaucucggcgaaugcgacuggcacauggaggccuccccuacaacccaguucgacaccggggaugucauuaaacaaaucaaugugaagcaggagagcgcuuuugcgccccaucugggaacaauucaggccgacggccuuucugauguuuccgugaacacgaauaugaucgcuaaacugggcugggucagcccggugucugacgggcacagaggaaacgucgauccuugggugauuccccgguauggcagcacccucacagaagccgcccagcuggcucccccuaucuacccgcccggguucggagaggccaucguuuucuucauguccgacuuuccuauugcucauggcaccaaugggcugucugugcccuguacaaucccucaagaguucgucacccacuuugugaacgaacaggcccccacgcgcggcgaagcggcccuccugcacuaucuugauccugacacacauagaaaucugggagaguucaagcucuaccccgagggcuuuaugaccugcguuccgaacagcuccgggaccggaccucagacacugcccauuaauggcguguucgucuuugugagcugggugucucgguucuaccagcuuaaaccuguugggaccgcuggacccgcccgcagacuguga

SEQ ID NO: 29019 - RNA, 1623 nt, Artificial Sequence
  derived and/or modified sequence opt5 from VP1__Norovirus_and/or_Norovirus-like__LC101821
augaugauggccagcaaggacgcugcccccuccgcggauggcgcuaccggggccggacagcuggugccugaggucaacacagccgacccgauccccauugauccuguugcuggcucuagcacggcccucgcuaccgccgggcaagugaaucugaucgaccccuggauuaucaacaauuucgugcaggcgccucagggagaauuuacaauuucccccaacaauaccccuggcgauguccuuuucgaccugcagcucgggccgcaccugaaccccuuucuuucucaucugagccaaauguacaauggaugggugggcaacaugagaguucgggugguccucgccggcaaugcuuucacagccgggaaagugaucaucugcuguguuccucccggauuucagucccgcacccugucuauugcucaggccacacuguucccucacgugaucgcggaugucagaacccucgaccccguggaggugccgcuggaagauguccggaacguucuuuaucauaauaacgacacgcagccuaccaugcgccugcucugcaugcuguacacaccccuuagaaccggcggggccagcggaggcacagauuccuuugugguggcugggcggguccugaccuguccuggacccgacuucaauuuucucuuccuggugcccccuacgguugagcaaaagacacgcccguuuaccgugcccaacauuccucugaaauaucucagcaauucuagaauccccaacccuauugaaggcaugucccugagccccgaucagacacagaacguccaguuccaaaauggccggugcaccaucgacgggcagccgcuuggaaccacaccugugucuguuucccagcuguguaaguuucgcggcagaauuacgagcgggcaaaaagugcucaaccugaccgagcuugacggaucucccuucauggccuucgcugccccugcccccgucggcuuuccugaucugggguccugcgacuggcacaucgagaugagcaagauccccaauuccucuacacagagcaacccgauuguggucaauuccgugaagccuaacagccagcaguucguuccccaucucucuuccaucacccuggaugacaaugugagcucuggaggcgauuacauuggcacaauccaauggaccagcccucccuccgggucuggaggcgcuaacacgaauuuuuggaaaauuccggacuaugggagcucccuggcggaagccagccagcucgcucccgccgucuacccucccggauucaacgaggugaucguuuauuuuauggccucuaucccuggccccaaucaguccgggagcccuaaccuggugcccugucuucugccgcaggaauacauuacacacuucaucucugagcaagcuccuauucagggcgaggccgcgcuccugcacuacgucgaucccgacaccaaucggaaccuuggagaauuuaagcuguauccuggcggguaccugaccugcgugcccaauuccagcuccacaggaccgcagcagcucccucuggauggcguguucguuuuugcuucuugggucagccgcuucuaucaacucaaacccguggggaccgccggaccugccagaggccggcuguga

SEQ ID NO: 29020 - RNA, 1623 nt, Artificial Sequence
  derived and/or modified sequence opt5 from VP1__Norovirus_and/or_Norovirus-like__AY038598
augaugauggccagcaaggacgcucccccuaacauggauggcaccuccggggccggacagcuggugccggaggcgaauacagcugaacccaucucuauggagccugucgccggcgccgcuacggccgcugccaccgcggggcaaguuaacaugauugaccccuggaucauggauaauuacgugcaggccccucagggagaguucacaauuagccccaacaauaccccuggcgacauccucuuugaucugcagcuugggccgcaccugaaccccuuccucucccaucuggcucaaauguauaauggaugggugggcaacaugaaagucaaggugcuucuggccggcaaugcuuuuacagccgggaaaauuaucaucucuugcauuccucccggauucgcggcccagaacaucagcauugcucaggccaccauguuuccucacguuaucgcugacgugagaguccucgaucccauugaagugccgcuggaagacguuggcaaugugcuguuccauaacaauggggauacaccuaccaugcggcucgucuguaugcuguacacgccccuucgcgccuccggaucuagcuccggcaccgacccuuuugugaucgccgggcacgugcugacaugccccagccccgauuucucuuuucucuuccugggaccuccgaacgucgagcagaagaccaaacccuuuuccguuccuaaucuuccccugaacacacucagcaacucuagagugccuucccugauucggagcaugauggugucucgcgaccauggccaaaugguccaguuccagaauggcagagugacccuggaugggcagcuccaaggaacgacacccaccuccgcuagccagcuguguaagauccggggcuccguuuuucacgcgaacgggggaaauggcuauacacuuaccgagcuggacgggucuccguaccacgccuucgaaagcccugcucccaucggauucccugaccucggcgagugcgauuggcauauggaagccucccccaccacacaguuugacacgggcgaugugauuaagcaaaucaacgucaaacaggaggccgcuuucgccccucaccuggggaccauucaggcggacggacuuagcgaugugucuguuaauacaaacaugaucgcuaagcugggcugggugucccccgccagcgacgggcaucgcggaaaugucgauccgugggugauuccuagauauggcucuacccucacagaggccgcucagcuggccccucccaucuaucccccgggguuuggcgaagcuaucgucuucuuuaugagcgacuuccccauugcccacggagcgaacggccuguccgugccuuguaccaucccccaagaguuuguuacgcacuucgugaaugaacaggccccuacacgcggggaggcugcccuccugcauuaccuugaucccgacacccaccggaaccugggagaauuuaaacucuacccugagggcuucaugaccugcguccccaauucuagcgggacaggaccgcagacccugccuauuaacggcguguuuguuuucguguccugggucagcagauuuuaccagcuuaagcccguggggacagcuggcccugcccggucucuguga

SEQ ID NO: 29021 - RNA, 1623 nt, Artificial Sequence
  derived and/or modified sequence opt5 from VP1__Norovirus_and/or_Norovirus-like__KJ196292
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgauauccucuuugaccugcagcuugggccucaccugaauccguuccucucccaucuggcccaaauguauaacggaugggugggcaauaugaaagucaaggugcuucuggccggcaacgcuuuuaccgccgggaaaauuaucaucucuugcauucccccuggauucguugcgcagaaugugagcaucgcccaggcuacaauguuuccccacgucauugccgaugugagaguucucgaaccuaucgaagugccccuggaggacguccggaacgugcuguuccauaauaacgauaauaccccgacgaugcgccucguguguaugcuguacaccccucuuagagcuuccggcucuagcuccgggacagaccccuuugucauugccggacggguucugaccugcccuagccccgauuucucuuuucucuuccuggugcccccuaacguggagcagaagacaaaaccguuuuccguccccaaccuuccucugaauacccucagcaacucucgcgugcccucccugaucaagagcaugaugguuucuagagaccacggccaaauggugcaguuccagaaugggcgggucacgcuggauggacagcuccaaggcacaaccccuacauccgccagccagcuguguaagauucgcggcuccguguuucaugcuaacgggggaaauggcuauaaccuuaccgaacuggacgggucucccuaccacgcguucgagagcccggccccuaucggauuccccgaucucggcgaaugcgacuggcacauggaggcuuccccuaccacacaguuuaauacgggggacguuaucaaacaaauuaacgugaagcaggagagcgccuucgcuccccaucugggaaccauccaggccgauggccuuucugacgucuccgugaauacaaacaugauugccaaacugggcugggucagcccugugucugaugggcacaagggagacguugaucccugggugaucccgagauauggcagcacccucacagaagcggcucagcuggccccucccauuuaucccccuggguuuggagaggccaucgucuucuuuauguccgacuucccgaucgcucauggcaccaaugggcugucugugcccuguacgauuccucaagaauuuguuacacacuucgugaacgagcaggcccccacccggggcgaagcugcccuccugcacuaccuugauccugacacccaucgcaaucugggagaguuuaaacucuaccccgauggcuucaugacaugcgucccuaacagcuccgggaccggaccccagacacugccgaucaauggcguguuuguguucguuagcugggucucuagauuuuaccagcuuaagccuguggggacggcgggacccgcccggcgccuguga

SEQ ID NO: 29022 - RNA, 1623 nt, Artificial Sequence
  derived and/or modified sequence opt5 from VP1__Norovirus_and/or_Norovirus-like__JQ743331
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaaaaagugcucaaccugacagagcuugacggaucucccuucauggcuuucgccgcuccugcccccgccggcuuuccugaucugggguccugcgacuggcacaucgagaugagcaagauccccaauuccucuacccagagcaacccgauugucgucaauuccgugaagccuaacagccagcaguucgugccccaucucucuuccaucacacuggaugacaauguuagcucuggaggcgauuacauuggcaccauccaauggacgagcccucccuccgacucugggggagcuaacacaaauuuuuggaaaauuccggauuauggcagcucccuggcggaagccagccagcucgcucccgccguguacccucccggguucaacgaggucaucguguauuuuauggccucuaucccuggacccaaucaguccggcagcccuaaccugguucccugucuucugccgcaggaauacauuacccacuucaucucugagcaagcuccuauucagggggaggccgcgcuccugcacuacguggaccccgauaccaaucggaaccuuggcgaauuuaagcuguauccuggaggcuaccucacaugcguccccaauuccagcuccaccgggccgcagcagcugccucuggacggaguguucguguuugcuucuuggguuagccgcuucuaucaacucaaacccgucggcacagccgggccugccagaggacggcuguga

SEQ ID NO: 29023 - RNA, 1623 nt, Artificial Sequence
  derived and/or modified sequence opt5 from VP1__Norovirus_and/or_Norovirus-like__EF547394
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaaaaagugcucaaccugacagagcuugacggaucucccuucauggcuuucgccgcuccugcccccgccggcuuuccugaucugggguccugcgacuggcacaucgaggucagcaagauccccaauuccucuacccagagcaacccgauuguggucaauuccgugaagccuaacagccagcaguucguuccccaucucucuuccaucacacuggaugacaaugugagcucuggaggcgauuacauuggcaccauccaauggacgagcccucccuccgacucugggggagcuaacacaaauuuuuggaaaauuccggauuauggcagcucccuggcggaagccagccagcucgcucccgccgucuacccucccggguucaacgaggugaucguuuauuuuauggccucuaucccuggacccaaucaguccggcagcccuaaccuggugcccugucuucugccgcaggaauacauuacccacuucaucucugagcaagcuccuauucagggggaggccgcgcuccugcacuacgucgaccccgauaccaaucggaaccuuggcgaauuuaagcuguauccuggaggcuaccucacaugcgugcccaauuccagcuccaccgggccgcagcagcugccucuggacggaguguucguuuuugcuucuugggucagccgcuucuaucaacucaaacccgugggcacagccgggccugccagaggacggcuguga

SEQ ID NO: 29024 - RNA, 1623 nt, Artificial Sequence
  derived and/or modified sequence opt5 from VP1__Norovirus_and/or_Norovirus-like__AF394960
augaugauggccagcaaggacgcuacccccuccgccgauggcgcgacaggggcuggacagcuggugccugaggucaacacggccggcccgauccccauugacccuguugccgggucuagcaccgcucucgccacagcuggacaagugaaucugaucgaucccuggauuaucaacaauuucgugcaggccccucagggcgaauuuaccauuucccccaacaauacaccuggggacguccuuuucgaucugcagcucggaccgcaccugaaccccuuucuuucucaucugagccaaauguacaauggcugggugggcaacaugagaguucgggugguccucgcggggaaugccuucaccgcuggaaaagugaucaucugcuguguuccucccggcuuucagucccgcacacugucuauugcccaggcuacccuguucccucacgugaucgccgacgucagaacgcucgaucccguggaggugccgcuggaagacguccggaacguucuuuaucauaauaacgauacccagccuacaaugcgccugcucugcaugcuguacacaccccuuagaaccgggggagcgagcggcgggaccgacuccuuugugguggccggacggguccugacguguccuggccccgauuucaauuuucucuuccuggugcccccuacaguugagcaaaagacccgcccguuuacagugcccaacauuccucugaaauaucucagcaauucuagaauccccaacccuauugaaggcaugucccugagccccgaccagacccagaacguccaguuccaaaaugggcggugcaccaucgauggacagccgcuuggcacaacgccugugucuguuucccagcuguguaaguuucgcgggagaauuaccagcggacaaaaagugcucaaccugacagagcuugacggcucucccuucauggcuuucgccgcuccugcccccgccggguuuccugaccugggauccugcgauuggcacaucgagaugagcaagauccccaauuccucuacccagagcaacccgauugucgucaauuccgugaagccuaacagccagcaguucgugccccaucucucuuccaucacacuggacgauaauguuagcucuggcggcgacuacauugggaccauccaauggacgagcccucccuccgauucuggaggcgcuaacacaaauuuuuggaaaauuccggacuaugggagcucccuggcggaagccagccagcucgcucccgccguguacccucccggauucaacgaggucaucguguauuuuauggccucuaucccuggccccaaucaguccgggagcccuaaccugguucccugucuucugccgcaggaauacauuacccacuucaucucugagcaagcuccuauucagggcgaggccgcgcuccugcacuacguggaucccgacaccaaucggaaccuuggagaauuuaagcuguauccuggcggguaccucacaugcguccccaauuccagcuccaccggaccgcagcagcugccucuggauggcguguucguguuugcuucuuggguuagccgcuucuaucaacucaaacccgucgggacagccggaccugccagaggccggcuguga

SEQ ID NO: 29025 - RNA, 1623 nt, Artificial Sequence
  derived and/or modified sequence opt5 from VP1__Norovirus_and/or_Norovirus-like__AJ277616
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaaaaagugcucaaccugacaaaacuugacggaucucccuucauggcuuucgccgcuccugcccccgccggcuuuccuaaucugggguccugcgauuggcacaucgagaugagcaagauccccaacuccucuacccagagcaauccgauugucgugaacuccgucaagccuaauagccagcaguucgugccccaucucucuuccaucacacuggacgagaacguuagcucuggaggcgauuacauuggcaccauccaauggacgagcccucccuccgacucugggggagcuaauacaaacuuuuggaagauuccggauuauggcagcucccuggcggaagccagccagcucgcucccgccguguacccucuggucuucaaugaggugaucguuuauuuuauggccuguauccgggggcccaaccagugcggaucuccuaaucuugugcccugucuguccccucaggaauacauuacccacuucaucagcgagcaagcucccauucagggcgaggccgcgcuccugcacuacgucgacccggauaccaaccgcaaucuuggggaauuuaaacuguauccuggcggauaccucacaugcgugcccaacucuuccagcaccggcccucagcagcugccccuggacgggguguucguuuuugcuuccugggucucuagauucuaucaacucaagccggugggaacagccggcccugcccgggggcgccuguga

SEQ ID NO: 29026 - RNA, 1623 nt, Artificial Sequence
  derived and/or modified sequence opt5 from VP1__Norovirus_and/or_Norovirus-like__GQ413970
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaacgggugcucaaccugacagagcuugacggaucucccuucauggcuuucgccgcuccugcccccgccggcuuuccugaucugggguccugcgacuggcacaucgagaugagcaaaauccccaauuccucuacccagaacaauccgauugucgugaacagcgucaagccuaauucccagcaguucgugccccaucucagcucuaucacacuggaugacaacguuuccagcggaggcgauuacauuggcaccauccaauggacgucucccccuagcgacuccgggggagcuaauacaaacuuuuggaagauuccggauuauggcucuagccuggcggaagccucccagcucgcucccgccguguacccucccggguucaaugaggucaucguguauuuuauggccagcaucccuggacccaaccagucuggcuccccuaaucugguucccugucuucugccgcaggaauacauuacccacuucaucagcgagcaagcuccuauucagggggaggccgcgcuccugcacuacguggaccccgauaccaaccgcaaucuuggcgaauuuaaacuguauccuggaggcuaccucacaugcguccccaacucuuccagcaccgggccgcagcagcugccucuggacggaguguucguguuugcuuccuggguuucuagauucuaucaacucaagcccgucggcacagccgggccugcccggggacgccuguga

SEQ ID NO: 29027 - RNA, 1623 nt, Artificial Sequence
  derived and/or modified sequence opt5 from VP1__Norovirus_and/or_Norovirus-like__KT732281
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaaaaagugcucaaccugacagagcuugacggaucucccuucauggcuuucgccgcuccugcccccgccggcuuuccugaucugggguccugcgacuggcacaucgaggucagcaagauccccaauuccucuacccagggaaacccgauuguggucaauagcgugaagccuaacucccagcaguucguuccccaucucagcucuaucacacuggaugacaauguguccagcggcggcgauuacauugggaccauccaauggacgucucccccuagcgacuccggaggcgcuaacacaaauuuuuggaaaauuccggauuaugggucuagccuggcggaagccucccagcucgcucccgccgucuacccucccggauucaacgaggugaucguuuauuuuauggccagcaucccuggccccaaucagucuggguccccuaaccuggugcccugucuucugccgcaggaauacauuacccacuucaucagcgagcaagcuccuauucagggcgaggccgcgcuccugcacuacgucgaccccgauaccaaucggaaccuuggagaauuuaagcuguauccuggcggguaccucacaugcgugcccaauucuuccagcaccggaccgcagcagcugccucuggacggcguguucguuuuugcuuccugggucucucgcuucuaucaacucaaacccguggggacagccggaccugccagaggccggcuguga

SEQ ID NO: 29028 - RNA, 1623 nt, Artificial Sequence
  derived and/or modified sequence opt5 from VP1__Norovirus_and/or_Norovirus-like__AF414404
augaugauggccagcaaggacgcuacccccuccgccgauggcgcgacaggggcuggacagcuggugccugaggucaacacggccgacccgauccccauugauccuguugccggcucuagcaccgcucucgccacagcugggagagugaaucugaucgaccccuggauuaucaacaauuucgugcaagccccucagggagaauuuaccauuucccccaacaauacaccuggcgauguccuuuucgaccugcagcucgggccgcaccugaaccccuuucuuucucaucugagccagauguacaauggaugggugggcaacaugcggguucgcgugguccucgcgggcaaugccuucaccgcugggaaagugaucaucugcuguguuccucccggauuucaauccagaacacugucuauugcccaggcuacccuguucccucacgugaucgccgauguccggacgcucgaccccguggaggugccgcuggaagauguccgcaacguucuucaucacaauaacgacacccagccuacaaugagacugcucugcaugcuguauacaccccuucggaccggcggggcgagcggaggcaccgauuccuuuguggugagcgggcgcguccugacguguccuggacccgacuucaauuuucucuuccuggugcccccuacaguugagcagaagaccagaccguuuacagugcccaacauuccucugaaaugccucucuaauucccggauccccaacccuauugaaggcaugagccugucucccgaucaaacccagaacguccaguuccagaauggccgcuguaccaucgacgggcaaccgcuuggaacaacgccuguguccguuagccagcugugcaaguuuagaggccggauuaccucugggcagggagugcucaaccugacagagcuugacggcucccccuucauggccuucgcugccccugcucccgccggguuuccugaucugggaagcugugacuggcauaucgagauguccaaaauccccaauucuagcacccaaaacaauccgauugucgugaacuccgucaagccuaauagccagcaguucgugccccaccucucuuccaucacacuggaugaaaacguuagcucuggcggcgacuacauugggaccauccaguggacgagcccucccuccgauucuggaggcgccaauacaaacuuuuggaagauuccggacuaugggagcucccuggcugaggcgagccaacucgcccccgcuguguacccucccggauucaaugaagucaucguguauuuuauggccucuaucccuggccccaaccaguccgggagcccuaaucugguucccugccuucugccgcaggaguacauuacccacuucaucucugagcaggccccuauucaaggcgaagcugcccuccugcauuauguggaucccgacaccaaccgcaaucuuggagaguuuaaacuguacccuggcggguaccucacauguguccccaacuccagcuccaccggaccgcagcagcugccucuggauggcguguucguguuugcgucuuggguuagcagauucuaucagcucaagcccgucgggacagcuggaccugcccggggccgccuguga

SEQ ID NO: 29029 - RNA, 1623 nt, Artificial Sequence
  derived and/or modified sequence opt5 from VP1__Norovirus_and/or_Norovirus-like__AF414402
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugccgcguuccucccggauuucaguccagaacacugucuauugcccaggcuacccuguucccucacgugaucgccgauguccggacgcucgaccccguggaggugccgcuggaagauguccgcaacguucuuuaucauaauaacgacacccagccuacaaugagacugcucuguaugcuguacacaccccuucggaccggcggggcgagcggaggcaccgauuccuuugugguggucgggcgcgugcugacgugcccuggacccgacuucaauuuucucuuccugguucccccuacaguggagcaaaagaccagaccguuuacagcccccaacauuccucugaaauaucucagcaauucucggauccccaacccuauugaaggcaugucccugagccccgaucagacccagaacguccaguuccaaaauggccgcuguaccaucgacgggcagccgcuuggagcuacaccugugucuguuucccagcugugcaaguuuagaggccggauuacgagcgggcaacgcgcccucaaccugaccgagcuugacggaucucccuucauggcuuucgccgccccugcucccgcgggcuuuccugaucugggguccugugacuggcacaucgagaugagcaaaauccccaauuccucuacacagaacaauccgauuguggucaacagcgugaagccuaauucccagcaguucgucccccaucuccccagcaucacccuggaugaaaacgugucuuccggaggcgacuacauuggcacaauccaauggaccagcccuccgucugauagcgggggagccaauacgaacuuuuggaagauucccgacuauggcuccucucuggcugaggccagccagcucgccccugcuguuuaucccccuggguucaaugaagugaucgucuacuuuauggccuccauccccggaccuaaccagagcggcucucccaaucuggugccgugccuucugccucaggaguacauuacacacuucaucuccgagcaagcgcccauucagggggaagcugcccuccugcacuacguugauccugacaccaacagaaaucuuggcgaguuuaaacuguaucccggaggcuaccucaccugugugccgaacucuagcuccacagggccucagcagcugccccuggauggagucuucguguuugccagcugggugucccgguucuaucaacucaagccuguuggcaccgcugggcccgcccgcggaagacuguga

SEQ ID NO: 29030 - RNA, 1623 nt, Artificial Sequence
  derived and/or modified sequence opt5 from VP1__Norovirus_and/or_Norovirus-like__AJ313030
augaugauggccagcaaggacgcuacccccuccgccgauggcgcgcugggggcuggacagcucgugccugaggucaacacagccgacccgauccccauugauccuguugccggcucuagcacggcucuggccaccgcugggcaagugaaucuuaucgaccccuggauuaucaacaauuucgugcaggccccucagggagaauuuacaauuucccccaacaauaccccuggcgauguccuguucgaccuccagcuggggccgcaccuuaaccccuuucugucucaucucagccaaauguacaauggaugggugggcaacaugagaguucgggugguccuggcgggcaaugccuucacagcugggaaagugaucaucugcuguguuccucccggauuucagucccgcacccugucuauugcccaggcuacacucuucccucacgugaucgccgaugucagaacccuggaccccguggaggugccgcuugaagauguccggaacguucuguaucauaauaacgacacgcagccuaccaugcgccuccugugcaugcuuuacacaccccugagaaccggcggggcgagcggaggcacagauuccuuugugguggccgggcggguccucaccuguccuggacccgacuucaauuuucuguuccuggugcccccuacgguugagcaaaagacacgcccguuuaccgugcccaacauuccucucaaauaucugagcaauucuagaauccccaacccuauugaaggcaugucccuuagccccgaucagacacagaacguccaguuccaaucuggccggugcaccaucgacgggcagccgcugggaaccacaccuguguccguuagccagcucuguaaguuucgcggcagaauuacgucugggcaaaaagugcugaaucuuaccggacuggacggcucccccuucauggcuuucgccgcuccugcccccgccggguuuccugaucucggaagcugcgacuggcacaucgagauguccaagauccccaacucuagcacacagaauaacccgauugucaucaauuccgugaagccuaacagccagcaguucgucccccaucugucuuccauuacccuggaugagaaugugcucagcggcggcgacuacaucgggacaauucaauggaccucucccccuagcgauuccggaggcgcuaacacgaauuuuuggaaaaucccggacuaugggucuagccuggcggaagccucccagcuugcucccgccguuuacccucccggauucaacgaggugaucgucuauuuuauggccagcauuccuggccccaaucagucuggguccccuaaccuggugcccugucuccugccgcaggaauacaucacacacuucauuagcgagcaagcuccuauccagggcgaggccgcgcuucugcacuacguugaucccgacaccaaucggaaccucggagaauuuaagcuguauccuggcggguaccugaccugcgugcccaauucuuccagcacaggaccgcagcagcucccucuggauggcgucuucguguuugcuuccugggugucucgcuucuaucaacuuaaacccguugggaccagaggaccugcccggggccgccuguga

SEQ ID NO: 29031 - RNA, 1623 nt, Artificial Sequence
  derived and/or modified sequence opt5 from VP1__Norovirus_and/or_Norovirus-like__KM036381
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaaaaagugcucaaccugacagagcuugacggaucucccuucauggcuuucgccgcuccugcccccgccggcuuuccugaucugggguccugcgacuggcacaucgagaugagcaagauccccaauuccucuaccgaaagcaacccgauugucgucaauuccgugaagccuaacagccagcaguucgugccccaucucucuuccaucacacuggaugacaauguuagcucuggaggcgauuacauuggcaccauccaguggacgagcccucccuccgacucugggggagcuaacacaaauuuuuggaaaauuccgaacuauggcagcucccuggcggaggccagccaacucgcucccgccguguacccucccggguucaaugaagucaucguguauuuuauggccucuaucccuggacccaaccaguccggcagcccuaaucugguucccugucuucugccgcaggaguacauuacccacuucaucucugagcaggcuccuauucaaggggaagccgcgcuccugcacuacguggaucccgacaccaaccggaaucuuggcgaguuuaagcuguauccuggaggcuaccucacaugcguccccaacuccagcuccaccgggccgcagcagcugccucuggauggaguguucguguuugcuucuuggguuagccgcuucuaucagcucaaacccgucggcacagccgggccugccagaggacggcuguga

SEQ ID NO: 29032 - RNA, 1623 nt, Artificial Sequence
  derived and/or modified sequence opt5 from VP1__Norovirus_and/or_Norovirus-like__LN854563
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaacgggugcucaaccugacagagcuugacggaucucccuucauggcuuucgccgcuccugcccccgccggcuuuccugaucugggguccugcgacuggcacaucgagaugagcaaaauccccaauuccucuacccagaacaauccgauugucgugaacagcgucaagccuaauucccagcaguucgugccccaucucagcucuaucacacuggaugacauuguuuccagcggaggcgauuacaucggcaccauucaauggacgucucccccuagcgacuccgggggagcuaacacaaauuuuuggaagaucccggauuauggcucuagccuguccgaagcgagccagcucgcccccgcuguguacccucccggguucaacgaggucaucguguauuuuauggccucuauuccuggacccaaucaguccggcagcccuaaccugguucccugucuucugccgcaggaauacaucacccacuucauuucugagcaagccccuauccagggggaggcugcccuccugcacuacguggaccccgauaccaaucgcaaccuuggcgaauuuaaacuguauccuggaggcuaccucacaugcguccccaauuccagcuccaccgggccgcagcagcugccucuggacggaguguucguguuugcgucuuggguuagcagauucuaucaacucaagcccgucggcacagcugggccugcccggggacgccuguga

SEQ ID NO: 29033 - RNA, 1623 nt, Artificial Sequence
  derived and/or modified sequence opt5 from VP1__Norovirus_and/or_Norovirus-like__AB042808
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaacgggugcucaaccugacagagcuugacggaucucccuucauggcuuucgccgcuccugcccccgccggcuuuccugaucugggguccugcgacuggcacaucgagaugagcaaaauccccaauuccucuacccagaacaauccgauugucacaaacagcgugaagccuaauucccagcaguucgucccccaucucagcucuaucacccuggaugaaaacguguccagcggaggcgacuacauuggcacgauccaauggacaucucccccuagcgauuccgggggagcuaauaccaacuuuuggaagauuccggacuauggcucuagccuggcggaggccucccagcucgcucccgccguuuacccucccggguucaaugaagugaucgucuauuuuauggccagcaucccuggacccaaccagucuggcuccccuaaucuggugcccugucuucugccgcaggaguacauuacccacuucaucagcgagcaagcuccuauucagggggaagccgcgcuccugcacuacguugaucccgacacaaaccgcaaucuuggcgaguuuaaacuguauccuggaggcuaccugaccugcgugcccaacucuuccagcacagggccgcagcagcucccucuggauggagucuucguguuugcuuccugggugucuagauucuaucaacucaagcccguuggcacggccgggccugcccggggacgccuguga

SEQ ID NO: 29034 - RNA, 1623 nt, Artificial Sequence
  derived and/or modified sequence opt5 from VP1__Norovirus_and/or_Norovirus-like__EU004679
augagaaugagcgacggcgccgcccccaaggccaacggguccgaggcgucuggacaggaucuggugccuaccgcuaucgaacaagccgucccgauucagcccguugccggcagcgcucucgccgcuccugccgcggggcagaucaaucagauugaccccuggaucuuccaaaacuuugugcagugcccucugggagaguucuccauuucuccccggaauacaccuggcgaaauccuuuuugaucuggcccucgggccgggacugaaccccuaccuugcucaccugagcgccauguauacgggcugggugggcaauauggagguccagcucgugcuggcugggaacgccuucaccgcgggaaaaguuguggucgcccuggugccucccuacuuuccuaagggcucccucacaaccgcucagaucacauguuucccccauguuaugugcgacgugcgcacccuggaaccgauucaacuuccucugcucgaugucagacgggugcuguggcacgccacacaggaccaggaggagucuaugcgccuuguguguaugcuguauacgccccucagaaccaauagcccuggggaugaauccuuugucguuagcggacggcugcugucuaaacccgcugccgacuucaacuuuguguaccucacacccccuaucgagcgcaccauuuauagaaugguggaucugccgguccuucagccccggcugugcacccaugcccgcuggccugcucccaucuacggccuccugguggacccuucccuucccagcaauccgcaauggcagaacgggagaguucacguggauggaacacugcucggcaccacgccugucucuggcuccugggugagcuguuucgcggccgaagcugccuaugaguuucagucugggacaggagagguugccaccuucacacugauugaacaagacggcuccgcuuacgugcccggggaucgggccgcgccucugggauaccccgacuuuagcggccagcucgagaucgaaguccagaccgagaccacaaagacgggggacaaacugaaggugaccacauucgaaaugauucuuggaccuaccacaaaugucgaucaggcucccuaucaaggcaagguguacgccucccuggccguugcugccucucucgaccugguggauggccgcgucagagcugugccgcggagcaucuauggguuccaggacguuaucccugaguacaacgauggacuucuggugccccucgcgcccccuauuggcccguuucugcccggggagauccugcuccgcuucagaaccuauaugcggcagcuggacacggccgaugccgcugccgaagcuauugacugcgcccuuccucaggaguuuaucuccugguucgcgagcaaugccuuuacaguccaagcugaugcccugcuccugagauaccgcaacacccugaccggacagcuucucuucgaauguaaacuguauucugagggcuacauugcucuguccuacagcgggucugcuccccucacauuuccuaccgacggcuucuuugaaguggugagcuggguuccccggcuguuccagcuugccuccgucggaucucugacaacgggcagaacccucaaguga

SEQ ID NO: 29035 - RNA, 1623 nt, Artificial Sequence
  derived and/or modified sequence opt5 from VP1__Norovirus_and/or_Norovirus-like__EU004678
augagaaugagcgacggcgccgcucccaaggccaacggguccgaggcgucuggacaggaucuggugccuaccgcugucgaacaagccguuccgauccagcccguggccggcagcgcucucgccgcuccugccgcggggcagauuaaucagaucgaccccuggauuuuccaaaacuuugugcagugcccucugggagaguucuccaucucuccccggaauacaccuggcgaaauucuuuuugaucuggcccucgggccgggacugaaccccuaccuugcucaccugagcgccauguauacgggcugggucggcaauauggaggugcagcucguucuggcugggaacgccuucaccgcgggaaaaguggucguggcccugguuccucccuacuuuccuaagggcucccucacaaccgcucagaucacauguuucccccaugugaugugcgacguccgcacccuggaaccgauccaacuuccucugcucgaugugagacgggugcuguggcacgccacacaggaccaggaggagucuaugcgccuugucuguaugcuguauacgccccucagaaccaauagcccuggggaugaauccuuuguugugagcggacggcugcugucuaaacccgcugccgacuucaacuuuguguaccucacacccccuauugagcgcaccaucuauagaauggucgaucugccggugcuucagccccggcugugcacccaugcccgcuggccugcucccauuuacggccuccugguugacccuucccuucccagcaauccgcaauggcagaacgggagagugcacgucgauggaacacugcucggcaccacgccugugucuggcuccuggguuagcuguuucgcggccgaagcugccuaugaguuucagucugggacaggagagguggccaccuucacacugaucgaacaagacggcuccgcuuacguccccggggaucgggccgcgccucugggauaccccgacuuuagcggccagcucgagauugaagugcagaccgagaccacaaagacgggggacaaacugaaggucaccacauucgaaaugauccuuggaccuaccacaaauguggaucaggcucccuaucaaggccgcguuuacgccucccugaccgccguggcuucucucgaccuggucgauggcagagugcgggccguuccgcgcagcauuuauggguuccaggacgugaucccugaguacaacgauggacuucuggucccccucgcucccccuaucggcccguuucugcccggggaggugcugcucagauuccggacguauaugagacagcuggacacagccgaugcggccgcugaagccauugacugcgcccuuccucaggaguuuaucuccugguucgcuagcaaugcguuuaccgugcaaucugaugcccugcuccugcgcuaccggaacacccugacaggacagcuucucuucgaauguaagcuguauuccgagggcuacauugcucugagcuacucugggagcggcccccucaccuuuccuacagacggauucuuugaaguugucuccugggugcccagacuguuccagcuugccucugugggcagccugacgaccgggcgcacacucaaauga

SEQ ID NO: 29036 - RNA, 1623 nt, Artificial Sequence
  derived and/or modified sequence opt5 from VP1__Norovirus_and/or_Norovirus-like__AB281085
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaaugugaccaucaccaaccugaauggcuccccguucgacccuagcgaagauauucccgcgccucucgggguccccgacuuccagggacgcguguuuggcgucaucucucaaagagauaagcacauugccuccgggcauaacgagccugcuaaucggggacacgacgccgugguucccacauacacggcccaguacaccccgaaacugggccagauccaaaucgggacauggcagaccgaugaccugacagugaaccagccugucaaguucacccccgugggacucaaugauacggaccauuuuaaccaguggguugugccccgcuaugcuggcgcccugaaucuuaacacaaaucuggcgccuagcgucgcuccgguguuccccggcgaaagacuccuguuuuuccgguccuacauuccucuuaaagggggauauggcaaccccgccaucgauugccugcucccucaagagugggugcagcacuuuuaccaggagucugcccccagcauguccgaaguugcucugguccgcuauauuaauccugacaccgggagagcccuguucgaggcuaagcuccaccgggccggauuuaugaccgugagcucuaacacauccgcgcccguggucgugccggccaacggcuacuucagauuugauagcuggguuaaucaguucuauucucuggcuccuauggggaccggcaacggacgccggagauga

SEQ ID NO: 29037 - RNA, 1623 nt, Artificial Sequence
  derived and/or modified sequence opt5 from VP1__Norovirus_and/or_Norovirus-like__AB662868
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaacaccuuuauaaugugaccaucauuaaccugaauggcagcccguucgacccuucugaggacauccccgcuccucucgggguccccgauuuccagggacgcguguuuggcgucauuucccaaagagacaagcacaacaccccugggcauaaugaacccgcgaaccgggcccacgaugcugugguuccgacauacacggcccaguacaccccuaaacugggacagauccaaaucggcacauggcagaccgacgaucugacaaauaaccagcccgugaaguucacccccgucgggcucaaugacacggagcauuuugaucagugggugguuccucgcuaugccggagcucugaaccuuaauacaaaccuggccccgagcguggcgcccgucuucccuggcgagagacuccuguuuuuccgguccuacauuccccuuaaaggcggguauggaaccccugcuaucgacugccugcucccccaagaaugggugcagcacuuuuaccaggaggccgccccuucuaugagcgaaguggcucugguucgcuauauuaaucccgauaccggcagagcccuguucgaggcuaagcuccaccgggccggguuuaugacagucuccagcaacaccucugcgccggugguggucccugccaacggauacuucagauuugacuccugggugaaucaguucuauagccuggcucccaugggcacagggaacggccgccggagauga

SEQ ID NO: 29038 - RNA, 1623 nt, Artificial Sequence
  derived and/or modified sequence opt5 from VP1__Norovirus_and/or_Norovirus-like__AB662861
augaagauggccagcaacgacgcugugcccuccaccgauggcgccgcggggcuggucccugagucuaauaacgaaguuauggcucucgagccgguggccggagccgcucuggccgcucccgugacaggccagacgaauaucauugacccuuggaucagagccaacuucguccaagcgcccaauggggaauuuaccgugagcccucggaacucccccggagagguucuucugaaucucgaacugggcccugagcuuaacccguaccuggcccaccucgcucgcauguauaauggguacgccggaggcauggaggugcaggucaugcuggcuggcaacgccuucacagcggggaaacugguguuugccgcuguucccccucauuuccccguggaaaaucucucuccucagcagauuaccauguuuccccacgucaucauugaugugagaacacuggagccggugcuucugccucuccccgacguccggaacaauuucuuucauuauaaccaaaaggaugacccuaaaaugcgcaucguugccaugcuguacacaccccuuagaagcaauggauccggcgaugacguguucaccgugucuugccggguccugacccgccccagcccugauuuugacuucacguaucucgugccgcccaccguugaauccaagacaaaaccuuuuacccugcccauccugacacucggggagcugagcaacucuagauucccuguguccauugaucagauguacaccagccccaacgaggucaucucugugcagugucagaauggacggugcacgcuugacggcgaacugcaagggacaacccagcuccagguuuccggaauuugugcuuuuaagggcgaggugacagcccaucugcacgauaacgaacaccuuuauaaugucaccaucaccaaccugaauggcagcccguucgacccuucugaggacauucccgccccucucggggugcccgauuuccagggacgcgucuuuggcgugaucucccaaagagacaagcacaacacaccugggcauaaugaacccgcuaaccgggcgcacgaugccguugugccgacguacaccgcucaguacacaccuaaacugggacagguccaaauuggcaccuggcagacagacgaucugaccgacaaucagcccgugaaguucacgcccguugggcucaacgauacagagcauuuuaaucaguggguggucccucgcuaugccggagcccugaaccuuaauaccaaccuggcuccgagcguggcccccguguucccuggcgagagacuccuguuuuuccgguccuacaucccccuuaaaggcggguauggaaccccugcgaucgacugccugcucccccaagaauggguucagcacuuuuaccaggaggcugccccuucuaugagcgaagucgcccuggugcgcuauauuaaucccgauacaggcagagcucuguucgaggccaagcuccaccgggcuggguuuaugaccguguccagcaacacaucugccccggucgugguuccugcgaacggauacuucagauuugacuccugggugaaucaguucuauagccuggcccccaugggcacggggaacggccgccggagauga

SEQ ID NO: 29039 - RNA, 1623 nt, Artificial Sequence
  derived and/or modified sequence opt5 from VP1__Norovirus_and/or_Norovirus-like__LC145791
augaagauggccagcaacgacguggcucccuccaccgauggcgccgcggggcuggucccugagucuaauaacgaaguuauggcucucgagccgguggccggagccgcucuggccgcucccgugacaggccagacgaauaucauugacccuuggaucagagccaacuucguccaagcgcccaauggggaauuuaccgugagcccucggaacucccccggagagguucuucugaaucucgaacugggcccugagcuuaacccguaccuggcccaccucgcucgcauguauaauggguacgccggaggcauggaggugcaggucaugcuggcuggcaacgccuucacagcggggaaacugguguuugccgcuguucccccucauuuccccguggaaaaucucucuccucagcagauuaccauguuuccccacgucaucauugaugugagaacacuggagccggugcuucugccucuccccgacguccggaacaauuucuuucauuauaaccaaaaggaugacccuaaaaugcgcaucguugccaugcuguacacaccccuuagaagcaauggauccggcgaugacguguucaccgugucuugccggguccugacccgccccagcccugauuuugacuucacguaucucgugccgcccaccguugaauccaagacaaaaccuuuuacccugcccauccugacacucggggagcugagcaacucuagauucccuguguccauugaucagauguacaccagccccaacgaggucaucucugugcagugucagaauggacggugcacgcuugacggcgaacugcaagggacaacccagcuccagguuuccggaauuugugcuuuuaagggcgaggugacagcccaucugcacgauaacgaccaccuuuauaaugucaccaucaccaaccugaauggcagcccguucgacccuucugaagauauucccgccccucucggggugcccgacuuccagggacgcgucuuuggcgugaucucccaaagagauaagcacaacacaccugggcauaaugagcccgcuaaccgggcgcacgacgccguugugccgacguacaccgcucaguacacaccuaaacugggacagauucaaaucggcaccuggcagacagaugaccugaccgucaaucagcccgugaaguucacgcccguugggcucaacgauacagaccauuuuaaucaguggguggucccucgcuaugccggagcccugaaccuuaauaccaaccuggcuccgagcguggcccccguguucccuggcgaaagacuccuguuuuuccgguccuacaucccccuuaaaggcggguauggaaccccugcgauugauugccugcucccccaagaguggguucagcacuuuuaccaggaggcugccccuucuaugagcgaagucgcccuggugcgcuauaucaaucccgacacaggcagagcucuguucgaggccaagcuccaccgggcuggguuuaugaccguguccagcaacacaucugccccggucgugguuccugcgaacggauacuucagauuugauuccugggugaaucaguucuauagccuggcccccaugggcacggggaacggccgccggagauga

SEQ ID NO: 29040 - RNA, 1623 nt, Artificial Sequence
  derived and/or modified sequence opt5 from VP1__Norovirus_and/or_Norovirus-like__LC145790
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaaguucacgcccguggggcucaacgauacagaccauuuuaaucaguggguugugccucgcuaugccggagcucugaaccuuaauaccaaccuggccccgagcgucgcgcccguguucccuggcgaaagacuccuguuuuuccgguccuacaucccccuuaaaggcggguauggaaccccugcuauugauugccugcucccccaagagugggugcagcacuuuuaccaggaggccgccccuucuaugagcgaaguugcucugguccgcuauaucaaucccgacacaggcagagcccuguucgaggcuaagcuccaccgggccggguuuaugaccguguccagcaacacaucugcgccgguggucgugccugccaacggauacuucagauuugauuccuggguuaaucaguucuauagccuggcucccaugggcacggggaacggccgccggagauga

SEQ ID NO: 29041 - RNA, 1623 nt, Artificial Sequence
  derived and/or modified sequence opt5 from VP1__Norovirus_and/or_Norovirus-like__LC145793
augaagauggccagcaacgacgcugcccccuccaccgauggcgcggcugggcuggugccugagucuaauaacgaagucauggcccucgagccgguugccggaguggcucuggccgcucccgugacaggccagacgaauaucauugacccuuggaucagagccaacuucguccaagcgcccaauggggaauuuaccgugagcccucggaacucccccggagagguucuucugaaucucgaacugggcccugagcuuaacccguaccuggcccaccucgcucgcauguauaauggguacgccggaggcauggaggugcaggucaugcuggcuggcaacgccuucacagcggggaaacugguguuugccgcuguucccccucauuuccccguggaaaaucucucuccucagcagauuaccauguuuccccacgucaucauugaugugagaacacuggagccggugcuucugccucuccccgacguccggaacaauuucuuucauuauaaccaaaaggaugacccuaaaaugcgcaucguugccaugcuguacacaccccuuagaagcaauggauccggcgaugacguguucaccgugucuugccggguccugacccgccccagcccugauuuugacuucacguaucucgugccgcccaccguugaauccaagacaaaaccuuuuacccugcccauccugacacucggggagcugagcaacucuagauucccuguguccauugaucagauguacaccagccccaacgaggucaucucugugcagugucagaauggacggugcacgcuugacggcgaacugcaagggacaacccagcuccagguuuccggaauuugugcuuuugagggcgaagugacagcccaucugcacgauaacgaccaccuuuauaaugucaccaucaccaaccugaauggcagcccguucgacccuucugaggauauucccgccccucucggggugcccgacuuccagggacgcgucuuuggcgugaucucccaaagagauaagcacaacacaccugggcauaaugaacccgcuaaccgggcgcacgacgccguugugccgacguacaccgcucaguacacaccuaagcugggacagauucaaaucggcaccuggcagacagaugaccugaccgucaaucagcccgugaaauucacgcccguugggcucaacgauacagaccauuuuaaucaguggguggucccucgcuaugccggagcccugaaccuuaauaccaaccuggcuccgagcguggcccccguguucccuggcgagagacuccuguuuuuccgguccuacaucccccuuaagggcggguauggaaccccugcgauugauugccugcucccccaagaguggguucagcacuuuuaccaggaagcugccccuucuaugagcgaggucgcccuggugcgcuauaucaaucccgacacaggcagagcucuguucgaagccaaacuccaccgggcuggguuuaugaccguguccagcaacacaucugccccggucgugguuccugcgaacggauacuucagauuugauuccugggugaaucaguucuauagccuggcccccaugggcacggggaacggccgccggagauga

SEQ ID NO: 29042 - RNA, 1623 nt, Artificial Sequence
  derived and/or modified sequence opt5 from VP1__Norovirus_and/or_Norovirus-like__LC145792
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaccuucaugauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaaguucacgcccguggggcucaacgauacagaccauuuuaaucaguggguucugccucgcuaugccggagcucuuaaccugaauaccaaccucgccccgagcguggcgcccgucuucccuggcgaaagacugcuguuuuuccgguccuacaucccccugaaaggcggguauggaaccccugcuauugauugccuccugccccaagagugggugcagcacuuuuaccaggaggccgccccuucuaugagcgaaguggcucugguucgcuauaucaaucccgacacaggcagagcccucuucgaggcuaagcugcaccgggccggguuuaugaccgucuccagcaacacaucugcgccggugguggucccugccaacggauacuucagauuugauuccugggugaaucaguucuauagccuugcucccaugggcacggggaacggccgccggagauga

SEQ ID NO: 29043 - RNA, 1623 nt, Artificial Sequence
  derived and/or modified sequence opt5 from VP1__Norovirus_and/or_Norovirus-like__LC145797
augaagauggccagcaacgacgcugcccccuccaccgauggcgcggcugggcuggugccugagucuaauaacgaagucauggcccucgagccgguugccggaguggcucuggccgcucccgugacaggccagacgaauaucauugacccuuggaucagagccaacuucguccccgcgccuaauggggaauuuaccgugagcccccggaacuccccuggagagguucuucugaaucucgaacugggcccggagcuuaaccccuaccuggcccaccucgcucgcauguauaauggguacgccggaggcauggaggugcaagucaugcuggcuggcaacgccuucacagcggggaaacugguguuugccgcuguuccuccccauuucccuguggaaaaucucucuccccagcagauuaccauguuuccgcacgucaucauugaugugagaacacuggagccugugcuucugccccucccugacguccggaacaauuucuuucauuauaaccagaaggaugaccccaaaaugcgcaucguugccaugcuguacacaccccuuagaagcaauggauccggcgaugacguguucaccgugucuugccggguccugacccgcccuagcccggauuuugacuucacguaucucgugcccccuaccguugaauccaagacaaaacuguuuacccugcccauccucacacugggggagcuuagcaacucuagauucccuguguccauugaucaaauguacaccagccccaacgaggucaucucugugcagugucagaauggacggugcacgcuggacggcgaacuccaggggacaacccaacugcagguuuccggaauuugugcuuuuaagggcgaggugacagcccaccuucaugauaacgaccaccuguauaaugucaccaucaccaaccucaauggcagcccguucgacccuucugaagauauucccgccccucugggggugcccgacuuccagggacgcgucuuuggcgugaucucccagagagauaagcacaacauuagcgggcauaaugagccugcuaaccgggcgcacgacgccguugugcccacauacacggcucaauacaccccgaaacugggacagauccagaucggcacauggcaaaccgaugaccucacagucaaucagccugugaaguucacccccguugggcugaacgauacggaccauuuuaaucaguggguggucccccgcuaugccggagcccuuaaccugaauacaaaccucgcuccuuccguggccccgguguuccccggcgaaagacugcuguuuuuccggucuuacauuccucuuaaaggcggguauggaacccccgcgaucgauugccuccugccucaggaguggguucaacacuuuuaccaggaggcugcccccagcauguccgaagucgcccuggugcgcuauauuaauccugacaccggcagagcucucuucgaggccaagcugcaccgggcuggguuuaugacagugagcucuaacaccuccgcccccgucgugguuccggcgaacggauacuucagauuugauagcugggugaaucaguucuauucucuugccccuaugggcacagggaacggccgccggagauga

SEQ ID NO: 29044 - RNA, 1623 nt, Artificial Sequence
  derived and/or modified sequence opt5 from VP1__Norovirus_and/or_Norovirus-like__LC145808
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacgcgccugggcauaaugagcccgccaaccgggcucacgacgccgugguuccgacauacacggcccaguacaccccuaaacugggacagauucaaaucggcacauggcagaccgaugaccugacagugaaucagcccgucaaguucacccccguggggcucaacgauacggaccauuuuaaucaguggguugugccucgcuaugcuggagcccugaaccuuaauacaaaccuggcgccgagcgucgcucccguguucccuggcgaaagacuccuguuuuuccgguccuacaucccccuuaaaggcggguauggaaccccugccauugauugccugcucccccaagagugggugcagcacuuuuaccaggaggccgcuccuucuaugagcgaaguugcccugguccgcuauaucaaucccgacaccggcagagcucuguucgaggccaagcuccaccgggcgggguuuaugacaguguccagcaacaccucugccccgguggucgugccugcuaacggauacuucagauuugauuccuggguuaaucaguucuauagccuggcccccaugggcacagggaacggccgccggagauga

SEQ ID NO: 29045 - RNA, 1623 nt, Artificial Sequence
  derived and/or modified sequence opt5 from VP1__Norovirus_and/or_Norovirus-like__LC145801
augaagauggccagcaacgacgcugcccccuccaccgauggcgcggcugggcuggugccugagucuacaaaugaagucauggcccucgagccgguugccggagcugcccuggcugcccccgugacgggccagaccaacaucauugacccuuggaucagagcgaauuucgugcaagcccccaacggggaauuuacagucagcccucgcaauucccccggagaggugcuucugaaccucgaacugggcccugagcuuaauccguaccuggcucaccucgcccggauguauaacggguacgcuggaggcauggagguucaggugaugcuggccggcaaugcguucaccgccgggaaacuggucuuugcugccgugcccccucauuuccccguugaaaaccucucuccucagcagauuacaauguuuccccacgugaucauugaugucagaacccuggagccggugcuucugccucuccccgacgugcggaauaacuucuuucauuauaaucaaaaggaugacccuaaaaugcgcaucgucgcuaugcuguacacaccccuuagaagcaacggauccggcgaugacguuuucaccgugucuugccgggugcugacgcgccccagcccugauuuugacuucaccuaucucgucccgcccacaguggaauccaagaccaaaccuuuuacacugcccauccugacccucggggagcugagcaauucuagauucccuguuuccauugaucagauguacacgagccccaacgaggugaucucuguccagugucagaacggacggugcacacuugacggcgaacugcaagggaccacacagcuccagguguccggaauuugugccuuuaagggcgagguuaccgcccaucugcacgauaaugaccaccuuuauaacgugaccaucacaaaucugaacggcagcccguucgacccuucugaagauauucccgcuccucucggggcgcccgacuuccagggacgcgucuuuggcgugaucucccaaagagauaagcacaauacgccugggcauaacgagcccgccaaucgggcucacgacgccgucgugccgaccuacacagcccaguacaccccuaaacugggacagauucaaaucggcacauggcagaccgaugaccugacgguuaaccagcccgugaaguucacacccgucgggcucaaugauaccgaccauuuuaaccagugggugguuccucgcuaugcuggagcccugaaucuuaacaccaaucuggcgccgagcguggcucccgucuucccuggcgaaagacuccuguuuuuccgguccuacaucccccuuaaaggcggguauggaaccccugccauugauugccugcucccccaagagugggugcagcacuuuuaccaggaggccgcuccuucuaugagcgaaguggcccugguucgcuauaucaaccccgacacaggcagagcucuguucgaggccaagcuccaccgggcgggguuuaugacagucuccagcaauacgucugccccggugguggucccugcuaacggauacuucagauuugauuccugggugaaccaguucuauagccuggcccccaugggcaccgggaauggccgccggagauga

SEQ ID NO: 29046 - RNA, 1623 nt, Artificial Sequence
  derived and/or modified sequence opt5 from VP1__Norovirus_and/or_Norovirus-like__AB662884
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaacuucacgcccguggggcucagcgauacagaccauuuuaaucaguggguugugccucgcuaugccggagcucugaaccuuaauaccaaccuggccccguccgucgcgcccguguucccuggcgaaagacuccuguuuuuccggucuuacaucccccuuaagggcggguauggaaccccugcuauugauugccugcucccccaagagugggugcagcacuuuuaccaggaggccgccccuagcauguccgaaguugcucugguccgcuauaucaaucccgacacaggcagagcccuguucgaggcuaaacuccaccgggccggguuuaugaccgugagcucuaacacauccgcgccgguggucgugccugccaacggauacuucagauuugauagcuggguuaaucaguucuauucucuggcucccaugggcacggggaacggccgccggagauga

SEQ ID NO: 29047 - RNA, 1623 nt, Artificial Sequence
  derived and/or modified sequence opt5 from VP1__Norovirus_and/or_Norovirus-like__LC145802
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaaugggcaugcuggaggcauggagguucaggugaugcuggccggcaacgcguucacagccgggaaacuggucuuugcugccgugcccccucacuuccccguugaaaaucucucuccucagcagauuaccauguuuccccaugugaucauugaugucagaacacuggagccggugcuucugccucuccccgacgugcggaacaauuucuuucacuacaaccaaaaggaugacccuaaaaugcgcaucgucgcuaugcuguauacaccccuuagaagcaauggauccggcgaugacguuuucaccgugucuugccgggugcugacccgccccagcccugauuuugaguucacguaccucgucccgcccaccguggaauccaagacaaaaccuuuuacccugcccauccugacacucggggagcugagcaacucuagauucccuguuuccauugaccagauguauaccagccccaacgaagugaucucuguccagugucagaauggacggugcacgcuugauggcgagcugcaagggacaacccagcuccaggccuccggaauuugugccuuuaagggcgaagugacagcucaucugcacgacaacgaucaccuuuacaauguuaccaucaccaaccugaauggcagcccguucgacccuucugaggacauucccgcgccucucggggugcccgauuuccagggacgcgucuuuggcgugaucucccaaagagacaagcauaacgccccugggcacaaugaacccgcuaaccgggcccaugaugccgucgugccgacauauacggcucaguacaccccuaaacugggacagauucaaaucggcacauggcagaccgacgaucugacaguuaaucagcccgugaaguucacccccgucgggcucaacgacacggaucacuuugaccagugggugguuccucgcuacgccggagcgcugaaucuuaacacaaaucuggcuccgagcguggcccccgucuucccuggcgagagacuccuguuuuuccgguccuauaucccccuuaaaggcggguacggaaccccugccauugauugccugcucccccaagagugggugcagcacuuuuaucaggaagcugccccuucuaugagcgagguggcucugguucgcuacaucaaccccgacaccggcagagcccuguucgaagcgaagcuccaucgggccggguuuaugacagucuccagcaauaccucugcuccggugguggucccugccaacggauauuucagauuugauuccugggugaaccaguucuacagccuggcucccaugggcacagggaauggccgccggagauga

SEQ ID NO: 29048 - RNA, 1623 nt, Artificial Sequence
  derived and/or modified sequence opt5 from VP1__Norovirus_and/or_Norovirus-like__AB662897
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaaguucacgcccguggggcucaacgauacagaccauuuuaaucaguggguugugccucgcuaugccggagcucugaaccuuaauaccaaccuggccccgagcgucgcgcccguguucccuggcgaaagacuccuguuuuuccgguccuacaucccccuuaaaggcggguauggaaccucugcuauugauugccugcucccucaagagugggugcagcacuuuuaccaggaggccgcccccagcauguccgaaguugcucugguccgcuauaucaauccugacacaggcagagcccuguucgaggcuaagcuccaccgggccggguuuaugaccgugagcucuaacacauccgcgcccguggucgugccggccaacggauacuucagauuugauagcuggguuaaucaguucuauucucuggcuccuaugggcacggggaacggccgccggagauga

SEQ ID NO: 29049 - RNA, 1623 nt, Artificial Sequence
  derived and/or modified sequence opt5 from VP1__Norovirus_and/or_Norovirus-like__AB662899
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaacuucacgcccguggggcucaaugauacagaccauuuuaaccaguggguugugccucgcuaugccggagcucugaaucuuaacaccaaucuggccccgagcgucgcgcccguguucccuggcgaaagacuccuguuuuuccgguccuacaucccccuuaagggcggguauggaaccccugcuauugauugccugcucccccaagagugggugcagcacuuuuaccaggaggccgccccuucuaugagcgaaguugcucugguccgcuauaucaaccccgacacaggcagagcccuguucgaggcuaaacuccaccgggccggguuuaugaccguguccagcaacacaucugcgccgguggucgugccugccaauggauacuucagauuugauuccuggguuaaccaguucuauagccuggcucccaugggcacggggaauggccgccggagauga

SEQ ID NO: 29050 - RNA, 1623 nt, Artificial Sequence
  derived and/or modified sequence opt5 from VP1__Norovirus_and/or_Norovirus-like__AB662894
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgccaacuucacgcccgucgggcucagcgauacagaccauuuuaaucagugggugguuccucgcuaugcuggagcccugaaccuuaauaccaaccuggcgccguccguggcucccgucuucccuggcgaaagacuccuguuuuuccggucuuacaucccccuuaagggcggguauggaaccccugccauugauugccugcucccccaagagugggugcagcacuuuuaccaggaggccgcuccuagcauguccgaaguggcccugguucgcuauaucaaucccgacacaggcagagcucuguucgaggccaaacuccaccgggcgggguuuaugaccgucagcucuaacacauccgccccggugguggucccugcuaacggauacuucagauuugauagcugggugaaucaguucuauucucuggcccccaugggcacggggaacggccgccggagauga

SEQ ID NO: 29051 - RNA, 1623 nt, Artificial Sequence
  derived and/or modified sequence opt5 from VP1__Norovirus_and/or_Norovirus-like__LC145803
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcucuuucgacccguccgaagauauuccugcuccccucgggaucccugacuuccagggacgcgucuuuggcgugauuagccaaagagauaagcacaacacacccgggcauaaugagccugcgaaccgggcccacgacgcugucgugcccacguacaccgcccaguacacaccgaaacugggacagauccaaaucggcaccuggcagacagaugaccugaccguuaaucagccugugaaguucacgcccgucgggcucaacgauacagaccauuuuaaucagugggugguuccccgcuaugccggagcucugaaccuuaauaccaaccuggccccuuccguggcgccggucuuccccggcgaaagacuccuguuuuuccggucuuacauuccucuuaaaggcggguauggaacccccgcuaucgauugccugcucccucaagagugggugcagcacuuuuaccaggaggccgcccccagcauguccgaaguggcucugguucgcuauauuaauccugacacaggcagagcccuguucgaggcuaagcuccaccgggccggguuuaugaccgucagcucuaacacauccgcgcccgugguggucccggccaacggauacuucagauuugauagcugggugaaucaguucuauucucuggcuccuaugggcacggggaacggccgccggagauga

SEQ ID NO: 29052 - RNA, 1623 nt, Artificial Sequence
  derived and/or modified sequence opt5 from VP1__Norovirus_and/or_Norovirus-like__AB662889
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaagagcuuuacccugccuauccugacacucggggagcugucuaacuccagauuccccguuagcauugaucagauguacaccucuccuaacgaggugaucuccguccagugucagaauggacggugcacgcuugacggcgaacugcaagggacaacccagcuccaggugagcggaauuugugccuuuaaaggcgagguuacagcccaucugcacgauaacgaccaccuuuauaaugugaccaucaccaaccugaauggcucucccuucgacccguccgaagauauuccugcuccccucggggucccugacuuccagggacgcguguuuggcgucaucagccaaagagauaagcacaacacacccgggcauaaugagccugcgaaccgggcccacgacgcugugguucccacguacaccgcccaguacacaccgaaacugggacagauucaaaucggcaccuggcagacagaugaccugaccgugaaucagccugucaacuucacgcccguggggcucuccgauacagaccauuuuaaucaguggguugugccccgcuaugccggagcucugaaccuuaauaccaaccuggccccuucugucgcgccgguguuccccggcgaaagacuccuguuuuuccggagcuacaucccucuuaagggcggguauggaacccccgcuauugauugccugcucccucaagagugggugcagcacuuuuaccaggaggccgcccccuccaugagcgaaguugcucugguccgcuauaucaauccugacacaggcagagcccuguucgaggcuaaacuccaccgggccggguuuaugaccgugucuuccaacacaagcgcgcccguggucgugccggccaacggauacuucagauuugauucuuggguuaaucaguucuauagccuggcuccuaugggcacggggaacggccgccggagauga

SEQ ID NO: 29053 - RNA, 1623 nt, Artificial Sequence
  derived and/or modified sequence opt5 from VP1__Norovirus_and/or_Norovirus-like__AB662876
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaacuucacgcccgccgggcucagcgauacagaccauuuuaaucagugggugguuccucgcuaugcuggagcccugaaccuuaauaccaaccuggcgccguccguggcucccgucuucccuggcgaaagacuccuguuuuuccggucuuacaucccccuuaagggcggguauggaaccccugccauugauugccugcucccccaagagugggugcagcacuuuuaccaggaggccgcuccuagcauguccgaaguggcccugguucgcuauaucaaucccgacacaggcagagcucuguucgaggccaaacuccaccgggcgggguuuaugaccgucagcucuaacacauccgccccggugguggucccugcuaacggauacuucagauuugauagcugggugaaucaguucuauucucuggcccccaugggcacggggaacggccgccggagauga

SEQ ID NO: 29054 - RNA, 1620 nt, Artificial Sequence
  derived and/or modified sequence opt5 from VP1__Norovirus_and/or_Norovirus-like__KU555841
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacgugggguccgaugcccccggaagcacacgcgcgcaacaggccugggucuccaccuauucuccgcaguucgugccuaaacuuggcagcgucaaucugagaauuuccgacaacgaugacuuucaguuccaacccacaaaguuuacccccguggggguuaaugaugacgauggacacccuuuccggcagugggaacucccgaacuacagcggcgagcugacgcuuaauaugaaccuggcucccccuguggcccccaauuuuccuggcgaacagcuccuguucuuuagaucuuucguccccugcuccgggggauacaaccagggcaucaucgacugucugauuccucaagaguggauccagcauuuuuaucaggaaagcgcccccucucagagcgauguggcucucauucgcuacguuaacccggacacagggcggacccuguucgaggccaagcugcacagauccggauauaucaccguggcgcacucuggcgauuacccucuggucgugcccgcuaaugggcauuuucgcuucgacagcugggugaaccaauucuauucccucgccccuaugggcacaggaaauggccggagacgcgcccaguga

SEQ ID NO: 29055 - RNA, 1620 nt, Artificial Sequence
  derived and/or modified sequence opt5 from VP1__Norovirus_and/or_Norovirus-like__GQ856468
augaagauggccagcaacgacgcugcccccuccaaugauggcgcgaccgggcuggugccugagaucaacacagaaacgcucccgcuggagcccgucgcuggagccgccauugcugccccuguuaccggccagaauaacaucauugaccccuggaucagaaauaacuucgugcaagcuccuaauggggaauuuacagugucuccccggaacagcccuggagagauucuuaugaaucuggaacucggcccggaucugaaccccuaccuugcccaccugucccgcauguauaauggguacgcgggaggcgucgaggugcagguucuccuggccggcaacgcuuucaccgccgggaaaauccuguuugcugccgugccucccaauuucccugucgacaugcucucucccgcgcagaucacaaugcugccgcaucuuauuguggauguuagaacccuggagccuaucaugauuccccucccugacgugcggaacgucuuuuaucacuucaauaaccagcccgcuccccgcaugagacugguggccaugcuuuacacaccucugcggagcaacggauccggcgaugacguguuuaccgucucuugccgcguucucacgagaccgacccccgauuucgaauuuacauaucuggugccucccagcguggaguccaagaccaaaccuuucacacugcccauccucaccauuggggaacugacgaauagccgguuuccggccccuaucgaccaacuuuacacaucucccaacgcugauauugucgugcagccucagaauggacgcuguacccuggacggcgagcuccaggggacaacccaacugcuuaccacagccaucugcuccuauagaggaaugacgagcaaccccaccucugauuacugggacgaccaucugcuccaccugguucauccuaauggcgccacauacgaucccaccgaggacgugccggcuccuuucggcacacaggauuuucgggggauccuguauggaaugcucacccagaacccccgcacguccggcgacgaagcggccaauagccacgggauuuacaucucuuccacaagcgagaaguucacccccaaacugggaaccauuggccuucaccagguccaagggagacauucccagcaccagcaaucuaaguucacaccugugggaaucgcuguuaacggcaauaccccguuucggcagugggaacugcccaacuauagcggcgcccucacacugaauacgaaccuugccccugcuguggggcccaauuucccuggagagcagauucuguuuuuccgcuccaacguccccagcgugcagggcgggcaaccuaucgaaaucgauugucucauuccccaggagugggucucucauuuuuaccaggaguccgccccgagccagucugacguggcgcugguuagauaugugaauccugauaccggacggacaaucuucgaagcuaagcugcacagacaaggcuuuauuaccaucgccgccacagggagcaaccccgucgugguuccucccaacggcuacuuccgcuuugacuccugggugaaucaguucuaugcucucgccccgaugggaaccggcaacgggcggagacgcguccaguga

SEQ ID NO: 29056 - RNA, 1620 nt, Artificial Sequence
  derived and/or modified sequence opt5 from VP1__Norovirus_and/or_Norovirus-like__AB684681
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauaauaaccagcccgcuaaccgcaugagacuugucgccaugcuguacacaccccuccggagcaauggcuccggggacgauguguucaccgugucuugccgcguccugacgagaccuaccccggacuuugaguucacauaucugguucccccuagcguggaauccaagaccaaacccuuuagccucccuauucugacacuuucugagcugaccaacucccgguuccccgcuccgaucgauagccucuuuacggcccaaaauaacgugcugcagguccagugucagaauggacgcugcacacuugacggcgagcugcaagggaccacacagcuccugccuaccggaauuugugccuucagaggccgggugaccgcugaaacagauaaccccgacaaguggcauaugcagcugcagaaucucaacggcacgaccuacgauccuacagacgacguucccgcgccucuggggacccccgauuuccgcggacuucuguuuggcguggccucucaaagaaaugucgggaacgacgcuccgggauccacacgggcccacgaggugguuaucagcaccacgucuccucaguucgugcccaaacucggcuccauuaauuuucgcagcacauccgaagauuucagaaccgggcagcccacccgguuuacaccugucggaaucaacgacgaggauaaucauccguucaaccaaugggaacugcccgacuauucuggcagacuuacccugaauaugaaccucgccccucccguggcuccuaacuuucccggcgagcagcugcuguucuuucgcagcaaugucccuugcuccgggggauacaaccagggcaucauugauugucucaucccccaggaguggauucaacacuucuaccaggaaagcgccccgucucaguccgagguggcgcugauccgguauguuaauccugacacagggagaacgcuuuuugaagcuaagcugcaccgcaccggauacauuacaguggcccauagcggcgauuauccccucgucgugccugccaacggguacuuccgguuugacucuuggguuaaucaguucuauagccuggcucccaugggcaccggaaacggcagacgccgggcccaauga

SEQ ID NO: 29057 - RNA, 1620 nt, Artificial Sequence
  derived and/or modified sequence opt5 from VP1__Norovirus_and/or_Norovirus-like__AB809988
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccgcggacaggacgccuucaucgauugucugcugccucaggaaugggucaaucacuuuuaccaagaggcugcccccucucaggcugacguggcccucauuagauauguuaacccugauacaggccggacccuguucgaagcgaaacuucacagaagcggguuuaucacagugucccauacgggagccuacccccuggucgugccgccuaacggccacuuccgcuuugacucuugggugaaucaguucuauagccucgcucccauggggaccggcaacggacggagauga

SEQ ID NO: 29058 - RNA, 1620 nt, Artificial Sequence
  derived and/or modified sequence opt5 from VP1__Norovirus_and/or_Norovirus-like__AB810011
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaaccgcggggauaauugggaccagaaccuucugcagcucaccuacccuucuggagcuuccuacgaucccaccgacgaggugccugcgccccugggcacacaagacuucagcggcauccuguaugggguccucacgcaggauaauguguccgaaggaaccggcgaggccaagaacgcuaaagggguuuacauuucuacaaccagcggaaaguuuacaccgaagaucggcuccauugggcugcauagcaucaccgaaaaugugcacccuaaccagcaaucuagauucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuucggucccgcguucccugcgugcaggggcucagaggacaggacgccuucaucgauugucugcugccucaggaaugggucaaucacuuuuaccaagaggcugcccccagccaggcugacguggcccucauucgguauguuaacccugauacaggcagaacccuguucgaagcgaaacuucaccgcucuggguuuaucacagugagccauacgggagccuacccccuggucgugccgccuaacggccacuuccgguuugacuccugggugaaucaguucuauucucucgcucccauggggaccggcaacggaagacgcuga

SEQ ID NO: 29059 - RNA, 1620 nt, Artificial Sequence
  derived and/or modified sequence opt5 from VP1__Norovirus_and/or_Norovirus-like__AB809994
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccagcgccaggacgccuucaucgauugucugcugccucaagaaugggucaaucacuuuuaccaggaggcugcccccucucaggcugacguggcccucauuagauauguuaacccugauacaggacggacccuguucgaagcgaaacuucacagaagcggcuuuaucacagugucccauacgggggccuacccccuggucgugccgccuaacggacacuuccgcuuugacucuugggugaaucaguucuauagccucgcucccaugggcaccgggaacggccggagauga

SEQ ID NO: 29060 - RNA, 1620 nt, Artificial Sequence
  derived and/or modified sequence opt5 from VP1__Norovirus_and/or_Norovirus-like__KX767083
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccaucccuguccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucucacaacuacaccaugaaucucgcuucccagaacuggaauagcuaugaucccaccgaggaaaucccugcgccccugggcacaccggacuucguggggaaaauccagggaguucuuacgcagaccacaagagccgacggcuccacccgggggcauaaggcuacaguguacaccggaucugccgauuuugccccuaagcugggccgcguccaauucgggacggacacaagcaacgauuuugaggcuaaucagaacaccaaauucacccccgugggaguuauucaggacggcgauacaacccacagaaaugaaccccaacagugggugcucccuuccuacagcggccggaacacacacaauguccaucuggccccggcgguggcucccacguuuccuggggagcagcuucuguucuuucgcucuaccaugcccggauguuccggcuauccuaacauggaccucgauugccugcugccccaggaaugggugcaacacuucuaccaggaggccgccccugcucagagcgacguugcccuccugagauuugucaaucccgauacagggcgggugcuuuucgaguguaagcugcauaaaccgggauaugugaccgucgcucacacaggccagcacgaccucgugaucccucccaacggguacuuuagauucgauucuuggguuaaccaauucuauacccuggccccuaugggcaauggaacgggccgccggagaguguga

SEQ ID NO: 29061 - RNA, 1620 nt, Artificial Sequence
  derived and/or modified sequence opt5 from VP1__Norovirus_and/or_Norovirus-like__LN854565
augaagauggccagcaacgacgcuaaucccuccgauggcucugccgcgaaccuggugccugaggucaauaacgaaguuauggcucucgagccgguggugggggccgccaucgcugcccccgucgcuggacagcaaaauaucaucgacccuuggauuagaaacaauuucgugcaggcccccggcggggaauuuaccguuagcccucggaacgcgcccggagagauccugugguccgccccucuuggcccggaucugaaucccuaccucucucaccuggcucgcauguauaacggguacgccggaggcuucgaagugcaggucauucuugcuggcaaugccuuuacagcggggaaaaucaucuucgccgcugugccucccaacuuuccuacggagggacugagccccucccagguuaccauguucccgcauauuaucguggacgucagacaacucgagccugugcugauuccccugccugaugugcggaauaacuuuuaucacuacaaucagucuaacgacagcacaaucaagcucauugccaugcuguauacaccccuucgcgcuaacaaugccggcgaugacgucuucaccguuuccugcagagugcugacccggcccagcccugauuuugacuucaucuuucucgugccgcccacagucgaaucucgcaccaaaccuuucacgauucccauccugaccguggaggaaaugacaaacuccagauuuccuaucccccuugagaagcuguacaccgggccgagcucugccuucguugugcagccucagaauggacgguguacaaccgauggcguccuccuggggacgacacaacugucccccgugaacauuugcaccuuccgcggagacguuacaaauauccagggcagccauaccuauaccaugaaccucgcuucucugaauuggaacaauuacgauccuacagaggaaacgcccgcgccucuuggcacccccgacuuuguggggaaaauucagggaguccugacacagaccacaaagggccaaggguccaccagaggacacaaggccacgguguacacaggcagcgcuuccuucaccccgaaacucgggucuguccaguuucggaccgacacacagaacgauuucgugacccaucaaaauacaaaguuuacgccuguuggagugauccaggacggcgauaccacacaccgcaacgagccccagcaguggguccugcccaauuauagcggcgugaacacccacaauguucaucuugccccugccguggcuccgacaauucccggggaacaacuccuguucuuuagauccagcaugccuggauguucuggcuaccccaacauggaccuggauugccuggucccucaggagugggugcagcacuucuaucaggaagccgcgcccgcucucuccgacguggcccugcuucgguuuguuaacccugauaccgggcgcguccuguucgaguguaaacuccauaagagcggauacgugacgguggcccacaccggccaccaugaccuggucauucccccgaauggguauuuuagauucgauucuugggugaaccaauuuuacacacuugcuccuaugggcaauggaaccggccggagacgcguuuga

SEQ ID NO: 29062 - RNA, 1620 nt, Artificial Sequence
  derived and/or modified sequence opt5 from VP1__Norovirus_and/or_Norovirus-like__KX354071
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagagauuacaccaugaaucucgcgucucugaacuggaauaacuaugacccuaccgaggaaauucccgccccucuuggcacacccgacuucguggggaaaauccagggaguccugacgcagaccacaaagggcgauggguccacccggggacacaaggcuacaguguacaccggcagcgccccguuuacgccuaaacucggguccguucaguucucuacagacaccgagaaugauuuugaaacccaucaaaacacaaaguucacccccgugggagucauucagaauggcagcacaacgcaccgcaacgagccccagcaaugggugcugccuuccuacagcggcagaaauguucagaacgugcaccuugccccggcugucgcccccaccuuuccuggggaacagcuccuguucuuucggucuacaaugcccggauguuccggcuauccuaauauggaccuggauugccugcucccccaggagugggugcaacauuucuaccaggaggcggcuccugcccagagcgacguggcccugcuucgcuuuguuaaccccgauaccgggagaguccuguucgaauguaaacuccacaagucuggauaugugacaguggcucauaccggccagcacgaccuggucaucccgccuaacggguacuuucgguucgauagcugggugaaucaauucuauacgcuugcccccaugggcaacggaaccggcagacgccggguuuga

SEQ ID NO: 29063 - RNA, 1620 nt, Artificial Sequence
  derived and/or modified sequence opt5 from VP1__Norovirus_and/or_Norovirus-like__AB933688
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagagacuacaccaugaaucucgcgucucugaacuggaauaacuaugauccuaccgaagagauucccgccccucuuggcacacccgacuucguggggaaaauccagggaaugcugacgcagaccacaaagggcgacggguccacccggggacacaaggcuacagucuacaccggcagcgccccguuuacgccuaaacucggguccgugcgcuucucuacagauaccgaaaaugacuuugagauucaucagaacaccaaguucacacccguuggagugauccaagauggcagcaccacacacagaaaugaaccccagcaguggguccugccuuccuacagcggccgggacgcccacaacgugcaucuugcuccggccguugcgcccacguuuccuggggagcaacuccuguucuuucgcucuaccaugcccggauguuccggcuauccuaauauggaucuggacugccugcucccccaggagugggugcagcacuucuaccaggaagcugccccugcccaaagcgaugucgcucugcuuagauuugugaaccccgacacagggcgggugcuguucgaguguaaacuccauaagucuggauauguuaccgucgcccacacaggccagcacgaucuggugauuccgccuaauggguacuuuagauucgacagcugggugaaccaguucuauacccuugcucccaugggcaacggaacgggccgccggagagucuga

SEQ ID NO: 29064 - RNA, 1620 nt, Artificial Sequence
  derived and/or modified sequence opt5 from VP1__Norovirus_and/or_Norovirus-like__GQ845337
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugaggcccaucaaaauaccaaguucacacccgugggagucauucaggacggcggcaccacacaccgcaacgaaccccagcaaugggugcugccuagcuacuccgggagaaauguuccgaacgugcaccuugcucccgccgucgcgccuacguuucccggagagcagcuccuguucuuucggagcaccaugccuggcuguucuggguaucccaauauggaucuggacugccugcucccucaggagugggugcagcauuucuaccaagaagcugcccccgcccaguccgauguggcucugcuucgcuuuguuaacccggacacaggaagaguccuguucgaguguaaacuccacaagagcggcuaugugaccguggcccauacagggcagcacgaucuggucaucccuucuaacggcuacuuucgguucgacagcugggugaaucaguucuauacccuugcucccaugggaaacggcacggggagacgccggguuuga

SEQ ID NO: 29065 - RNA, 1620 nt, Artificial Sequence
  derived and/or modified sequence opt5 from VP1__Norovirus_and/or_Norovirus-like__JX155747
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguucagaacgugcaccuugccccggcugucgcccccaccuuuccuggagagcagcuccuguucuuucggagcacaaugcccggcuguucuggguauccuaauauggaucuggacugccugcucccccaggagugggugcaacauuucuaccaggaagcggcuccugcccaguccgauguggcccugcuucgcuuuguuaaccccgacaccggaagaguccuguucgaguguaaacuccacaagagcggcuaugugacaguggcucauaccgggcagcacgaucuggucaucccgccuaacggcuacuuucgguucgacucuugggugaaucaauucuauacgcuugcccccaugggaaacggcaccgggagacgccggguuuga

SEQ ID NO: 29066 - RNA, 1620 nt, Artificial Sequence
  derived and/or modified sequence opt5 from VP1__Norovirus_and/or_Norovirus-like__JX155737
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagagcggcuaugugacaguggcucauaccgggcagcacgaucuggucaucccucccaacggcuacuuucgguucgacucuugggugaaucaguucuauacgcuugccccuaugggaaacggcaccgggagacgccggguuuga

SEQ ID NO: 29067 - RNA, 1620 nt, Artificial Sequence
  derived and/or modified sequence opt5 from VP1__Norovirus_and/or_Norovirus-like__KX354055
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagagccgacggcagcacccgggggcauaaggcuacagucuacaccggauccgccgauuuugccccuaagcugggccgcgugcaauucgagacggacacaaaucacgauuuugaagcuaaccagaauaccaaauucacccccguuggggugauccaggacggaggcacaacccacagaaacgagccccaacaguggguccucccuucuuacagcggccggaauacacauaacgugcaccuggccccggcgguggcucccacguuuccuggggaacagcuucuguucuuucgcuccaccaugcccggauguagcggcuauccuaauauggaucucgacugccugcugccccaggaguggguucaacauuucuaccaggaggccgccccugcucagucugaugucgcccuccugagauuugugaaccccgacacagggcgggugcuuuucgaauguaagcugcacaaauccggauaugucaccguggcucacacaggccagcaugaucucguuauuccgccuaacggguacuuuagauucgacagcugggugaaucaauucuauacccuggcccccaugggcaacggaacgggccgccggagagucuga

SEQ ID NO: 29068 - RNA, 1620 nt, Artificial Sequence
  derived and/or modified sequence opt5 from VP1__Norovirus_and/or_Norovirus-like__KX353957
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguuuaccggcagcgccccguucacgccuaaacucggguccguucaguuuucuacagacaccgaaaacgauuucgagacccaucaaaauacaaaguuuacccccgugggagucauucaggacggcggcacaacgcaccgcaacgaaccccagcaaugggugcugccuagcuacuccgggagaaauguucagaacgugcaccuugccccggcugucgcccccaccuucccuggagagcagcugcucuuuuuccggagcacaaugcccggcuguucuggguacccuaauauggaucuggacugccugcucccccaggagugggugcaacauuuuuaucaggaagcggcuccugcccaguccgauguggcccugcuucgcuucguuaaccccgacaccggaagaguccuguuugaguguaaacuccacaagagcggcuacgugacaguggcucauaccgggcagcacgaucuggucaucccgccuaacggcuauuuccgguucgacucuugggugaaucaauuuuacacgcuugcccccaugggaaacggcaccgggagacgccggguuuga

SEQ ID NO: 29069 - RNA, 1620 nt, Artificial Sequence
  derived and/or modified sequence opt5 from VP1__Norovirus_and/or_Norovirus-like__KF509947
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccuauccugacgguggaggaaaugaccaauagcagauuucccauuccgcuugagaagcuguucacagggccuucuuccgccuucgucgugcagccccagaacggacgguguaccacagauggcguucuccuggggaccacgcaacugagcccugugaauaucugcacauuucgcggagacaucacccauauuacaggcucuagaaacuacaccaugaaucucgcuucccagaacuggaauaacuaugaucccaccgaggaaaucccugcgccccugggcacaccggacuucgucgggaaaauucagggagugcuuacgcagaccacacgggccgacggcagcacccgcgggcacaaggcuaucgucuacacaggauccgccgauuuugccccuaagcugggcagagugcaauucgagaccgacacggaucaugacuuugaagcuaaucagaacacaaaauucacccccguuggggugacccaggauggaucuacaacccaccggaaugagccccaacaguggguccucccuagcuacuccggccgcaacacacacaaugugcaucuggccccggcgguugcucccacguuuccuggcgaacagcuucuguucuuuagaagcaccaugcccggguguucuggauauccuaacauggaccucgauugccugcugccccaggagugggugcaauacuucuaucaggaggccgccccugcucaguccgacgucgcccuccugcgguuugugaaucccgauacaggcagagugcuuuucgaauguaagcugcacaaaagcggguacguuaccgucgcucauacaggacagcacgaccucgugauuccgccuaacggcuauuuucgcuucgauucuugggugaaccaauucuacacccuggcccccauggggaauggcacgggacggagacgcgucuga

SEQ ID NO: 29070 - RNA, 1620 nt, Artificial Sequence
  derived and/or modified sequence opt5 from VP1__Norovirus_and/or_Norovirus-like__AB504326
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacauuaugaaccucgcgucucugaauuggaacaauuaugacccuaccgaagagauccccgccccucuuggcacccccgauuucguggggaaaauucagggaguccugacacagacgaccaagggcgacggguccacacggggacacaaggcuaccguguacacaggcagcgccccguuuaccccuaaacucggguccguucaguucucuacggacacagaaaacgauuuugagacccaucaaaauacccgcuucacacccgugggagucauccaggacggcggcaccacacacagaaacgaaccccagcaaugggugcugccuagcuacuccgggcggaauguuccgaacgugcaccuugcccccgcugucgccccuacguuucccggagagcagcuccuguucuuucgcagcaccaugccuggcuguucuggguaucccaauauggaucuggacugccugcucccucaggagugggugcagcauuucuaccaagaagcggcucccgcccaguccgauguggcccugcuuagauuuguuaacccggacacaggacggguccuguucgaguguaagcuccacaaaagcggcuaugugaccguggcucauacagggcagcacgaucuggucauuccucccaacggcuacuuuagauucgacucuugggugaaucaguucuauacccuugccccuaugggaaacggcacggggcgccggagaguuuga

SEQ ID NO: 29071 - RNA, 1620 nt, Artificial Sequence
  derived and/or modified sequence opt5 from VP1__Norovirus_and/or_Norovirus-like__KX354056
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccuauccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggaauaacuaugaucccaccgaggaaaucccugcgccccugggcacaccggacuucguggggaaaauccagggaguucuuacgcagaccacacgggccgacggcagcacccgcgggcacaaggcuacaguguacaccggauccgccgauuuugccccuaagcugggcagaguccaauucgggacggacacagaucaugacuuugaggcuaaucagaacaccaaauucacccccgugggaguuauucaggauggcggcacaacccaccggaaugaaccccaacagugggugcucccuucuuacagcgggcgcaacacacacaauguccaucuggccccggcgguggcucccacguuuccuggagagcagcuucuguucuuuagauccaccaugcccggcuguagcggguauccuaacauggaccucgauugccugcugccccaggaaugggugcaauacuucuaucaggaggccgccccugcucagucugacguugcccuccugcgguuugucaaucccgauacaggaagagugcuuuucgaguguaagcugcacaaacucggcuacgugaccgucgcucauacagggcagcacgaccuggugaucccgccuaacggcuauuuucgcuucgauuccuggguuaaccaauucuacacccuugcccccaugggaaauggcacggggcggagacgcguguga

SEQ ID NO: 29072 - RNA, 1620 nt, Artificial Sequence
  derived and/or modified sequence opt5 from VP1__Norovirus_and/or_Norovirus-like__AB541255
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacacgcuucacccccgugggagucauucaggacggcggcacaacgcacagaaacgaaccccagcaaugggugcugccuagcuacuccgggcggaauguuccgaacgugcaccuugcccccgcugucgccccuaccuuucccggagagcagcuccuguucuuucgcagcacaaugccuggcuguucuggguaucccaauauggaucuggacugccugcucccucaggagugggugcagcauuucuaccaagaagcggcucccgcccaguccgauguggcccugcuuagauuuguuaacccggacaccggacggguccuguucgaguguaagcuccacaaaagcggcuaugugacaguggcucauaccgggcagcacgaucuggucaucccucccaacggcuacuuuagauucgacucuugggugaaucaguucuauacgcuugccccuaugggaaacggcaccgggcgccggagaguuuga

SEQ ID NO: 29073 - RNA, 1620 nt, Artificial Sequence
  derived and/or modified sequence opt5 from VP1__Norovirus_and/or_Norovirus-like__KP784696
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguuggggagauccagggagugcuuacgcagaccacacggaccgacggcagcacacgcgggcacaaagccaccgucuacacgggauccgcugauuuugccccuaagcugggcagaauccaauucgaaacagacaccgaucaugacuuugaggccaaucagaacaccaaguucacacccguggggguuauucaggauggaucuaccacacaccggaaugaaccccaacagugggugcucccuagcuacuccggccgcaacacgcacaauguccaucuggcuccggccguggcgcccaccuuuccuggcgagcagcuucuguucuuuagaagcacaaugcccggguguucuggauauccuaacauggaccucgauugccugcugccccaggagugggugcaauacuucuaucaggaagcugccccuucccagagcgacguugcccuccugcgguuugucaaucccgauaccggcagagugcuuuucgaguguaaacugcacaagucuggguacgugacagucgcucauaccggacagcacgaccucgugaucccgccuaacggcuauuuucgcuucgauagcuggguuaaccaauucuacacgcuggcccccauggggaauggcaccggacggagacgcguguga

SEQ ID NO: 29074 - RNA, 1620 nt, Artificial Sequence
  derived and/or modified sequence opt5 from VP1__Norovirus_and/or_Norovirus-like__KX354042
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccugugcugacggucgaggaaaugaccaauagcagauuucccaucccgcuugagaagcuguucacagggccuucuuccgccuucgugguucagccccagaacggacgguguaccacagauggcgugcuccuggggaccacgcaacugagcucugucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauccaggauggaagcaccacacaccggaaugagccccaacagugggugcuccccuccuacagcggccgcaacacgcacaauguucaucuggcuccugccguggcgccgaccuuucccggcgaacagcuucuguucuuuagaucuacaaugccuggguguuccggauaucccaacauggaccucgauugccugcugccucaggaguggguccaauacuucuaucaggaggcugcccccgcccagagcgacguggcucuccugcgguuugugaauccugauaccggcagaguucuuuucgaauguaagcugcacaaaucuggguacgucacaguggcccauaccggacagcacgaccucgugauucccccgaacggcuauuuucgcuucgauagcugggucaaccaauucuacacgcuggcuccuauggggaauggcaccggacggagacgcguguga

SEQ ID NO: 29075 - RNA, 1620 nt, Artificial Sequence
  derived and/or modified sequence opt5 from VP1__Norovirus_and/or_Norovirus-like__KX354007
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaguuccugcgccccugggcacaccggacuucguggggaaaauucagggaaugcuuacgcagaccacacggaccgacggcagcacacgcgggcacaaggccaccgucuacacgggauccgcugauuuuacaccuaagcugggcagaauccaauucgagaccgacaccgaucaugacuuugaagccaaucagaacacaaaauucacccccguggggguuauccaggauggaucuacaacgcaccggaaugagccccaacagugggugcucccuagcuacuccggccgcaacacccacaauguccaucuggccccggcuguggcccccacauuuccuggcgaacagcuucuguucuuuagaagcaccaugcccggguguucuggauauccuaacauggaccucgauugccugcugccccaggagugggugcaauacuucuaucaggaggcggcuccugcccaguccgacguugcccuccugcgguuugucaaucccgauacaggcagagugcuuuucgaauguaagcugcacaaaagcggguacgugaccgucgcucauacgggacagcacgaccucgugauuccgccuaacggcuauuuucgcuucgauucuuggguuaaccaauucuacacccuggcccccauggggaauggcacaggacggagacgcguguga

SEQ ID NO: 29076 - RNA, 1620 nt, Artificial Sequence
  derived and/or modified sequence opt5 from VP1__Norovirus_and/or_Norovirus-like__KT780393
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagcggcuguucacagggccuucuuccgccuucgugguccagccccagaacggacgcuguaccacagauggcgugcuccuggggaccacgcaacugacaccugucaauauuugcaccuuuagaggagacgugacacauaucaccggcagccggaacuacaccaugaaucucgcuucucagaacuggaauaacuaugaucccacagaggaaauuccugcgccccugggcacgccggacuucguugggaagauccagggaaugcuuacccagacaacccgcacagacggcuccaccagagggcacaaagccacgguguacacaggaagcgcugauuuugccccuaagcugggccggguccaauucgagaccgacaccgaucaugacuuugaagccaaucagaacacaaaguucacccccguggggguuauccaggauggauccacaacgcaccgcaaugagccccaacagugggugcucccuucuuacagcggcagaaacacccacaauguccaucuggcuccggccguggcgcccacauuuccuggcgaacagcuucuguucuuucgguccaccaugcccggguguagcggauauccuaacauggaccucgauugccugcugccccaggagugggugcaacacuucuaccaggaggcugccccugcccagucugacguugcucuccugagauuugucaaucccgauacaggccgcgugcuuuucgaauguaaacugcauaaguccggguaugugaccgucgcccacacgggacagcacgaccucgugauuccgccuaacggcuacuuucgguucgauagcuggguuaaccaauucuauacccuggcucccauggggaauggcacaggaagacgccggguguga

SEQ ID NO: 29077 - RNA, 1620 nt, Artificial Sequence
  derived and/or modified sequence opt5 from VP1__Norovirus_and/or_Norovirus-like__KX354043
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauccaggauggaagcaccacacaccggaaugagccccaacagugggugcuccccuccuacagcggccgcaacacguauaauguucaccuggcuccugccguggcgccgaccuuucccggcgaacagcuucuguucuuuagaucuacaaugccuggguguuccggauaccccaacauggaccucgauugccugcugccucaggaguggguccaacauuucuaucaggaggcugcccccgcccagagcgacguggcucuccugcgguuugugaauccugauaccggcagaguucuuuucgaauguaagcugcacaaaucuggguacgucacaguggcccauaccggacagcacgaccucgugauucccccgaacggcuauuuucgcuucgauagcugggucaaccaauucuacacgcuggcuccuauggggaauggcaccggacggagacgcguguga

SEQ ID NO: 29078 - RNA, 1620 nt, Artificial Sequence
  derived and/or modified sequence opt5 from VP1__Norovirus_and/or_Norovirus-like__KX354008
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaguuccugcgccccugggcacaccggacuucguggggaaaauucagggaaugcuuacgcagaccacacggaccgacggcagcacacgcgggcacaaggccaccgucuacacgggauccgcugauuuuacaccuaagcugggcagaauccaauucgagaccgacaccgaucaugacuuugaagccaaucagaacacaaaauucacccccguggggguuauccaggauggaucuacaacgcaccggaaugagccccaacagugggugcucccuagcuacuccggccgcaacacccacaauguccaucuggccccggcuguggcccccacauuuccuggcgaacagcuucuguucuuuagaagcaccaugcccggguguucuggauauccuaacauggaccucgauugccugcugccccaggagugggugcaauacuucuaucaggaggcggcuccugcccaguccgacguugcccuccugcgguuugucaaucccgauacaggcagagugcuuuucgaauguaagcugcacaaaagcggguacgugaccgucgcuuauacgggacagcaugaccucgugauuccgccuaacggcuacuuucgcuucgauucuuggguuaaccaauucuauacccuggcccccauggggaauggcacaggacggagacgcguguga

SEQ ID NO: 29079 - RNA, 1620 nt, Artificial Sequence
  derived and/or modified sequence opt5 from VP1__Norovirus_and/or_Norovirus-like__KR904217
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucuccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccgggccuuccagcgcuuucgucgugcagccccagaacggacgguguucuacagauggcguucuccuggggaccacgcaacuguccccugugaauaucugcacauuucgcggagacgucacccauaucgccggcagccacaacuacacaaugaaucucgccucccagaacuggucuagcuaugaucccaccgaggaaauuccugcuccccugggcaccccggacuucguggggaaaauccagggaguccuuacacagacgaccagauccgacggcagcacacgggggcauaaggcgaccguguacacaggaucugccgauuuuuccccuaagcugggccgcguucaauucgcuaccgacacggauaaugacuuugugagcaaccagaauacaaaauucacccccgucggggugauucaggauggagacaccgcccacagaaacgagccccaacaguggguucucccuucuuacagcggccggaauauccacaacgugcaucuggccccggcugucgcccccacauuuccuggcgaacagcuucuguucuuucgcuccaccauucccggguguucuggauauccuaauauggaucucgacugccugcugccccaggagugggugcaauacuucuaucaggaagcggcuccugcccagagcgauguggcccuccugagauuuguuaaccccgacacaggccggguccuuuucgaguguaagcugcacaaauccggguacgugacgguggcucauaccggacagcacgaucucgucaucccgccuaauggcuauuuuagauucgacagcugggugaaccacuucuacacacuggcccccauggggaacggcaccggacgccggagaguuuga

SEQ ID NO: 29080 - RNA, 1620 nt, Artificial Sequence
  derived and/or modified sequence opt5 from VP1__Norovirus_and/or_Norovirus-like__KJ685412
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuugccccuaagcugggccgcgugcaauucgccacagacaccgaucacgacuuugaggcuaaucagaacaccaaauucacacccguuggggugauccaggauggaggcaccacacacagaaaugaaccccaacaguggguccucccuucuuacagcggccggaacacgcauaaugugcaccuggccccggcgguggcucccaccuuuccuggggagcagcuucuguucuuucgcuccacaaugcccggauguagcggcuauccuaacauggaccucgauugccugcugccccaggaauggguucaauacuucuaucaggaggccgccccugcucagucugacgucgcccuccugagauuugugaaucccgauaccgggcgggugcuuuucgaguguaagcugcauaaauccggauacgucacaguggcucacaccggccagcacgaccucguuauuccgccuaacggguauuuuagauucgauagcugggugaaccaauucuacacgcuggcccccaugggcaauggaaccggccgccggagagucuga

SEQ ID NO: 29081 - RNA, 1620 nt, Artificial Sequence
  derived and/or modified sequence opt5 from VP1__Norovirus_and/or_Norovirus-like__KF008240
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccacaccgcuugagaagcuguucaccgggccuucuuccgccuucgugguccagccccagaacggacgguguacaaccgauggcgugcuccuggggacgacacaacugagcccugucaauaucugcaccuuucgcggagacgugacacauauuaccggcucuagaaacuacaccaugaaucucgcuucccagaacuggaauaacuaugaucccacagaggaaaucccugcgccccugggcacgccggacuucguugggaaaauucagggagugcuuacccagacaacccggacagacggcagcacccgcgggcacaaggccacggucuacacaggauccgcugauuuugccccuaagcugggcagagugcaauucgagaccgacaccgaucaugacuuugaaguuaaucagaacacaaaauucacccccgugggggucauccaggauggaggcacaacgcaccggaaugagccccaacagugggugcucccuucuuacagcggccgcaacacccacaaugugcaucuggccccggcuguugcccccacauuuccuggggaacagcuucuguucuuuagauccaccaugcccggauguagcggcuauccuaacauggaccucgauugccugcugccccaggaguggguccaauacuucuaucaggaggcggcuccugcccagucugacguggcccuccugcgguuugugaaucccgauacagggagaguccuuuucgaauguaagcugcacaaauccggauacgugaccguugcucauacgggccagcacgaccucgugaucccgccuaacggguauuuucgcuucgauagcugggucaaccaauucuacacccuggcccccaugggcaauggaacaggccggagacgcguguga

SEQ ID NO: 29082 - RNA, 1620 nt, Artificial Sequence
  derived and/or modified sequence opt5 from VP1__Norovirus_and/or_Norovirus-like__KX354125
augaagauggccagcuccgacgcuaaccccucugauggcagcgccgcgaaucuggugccugaggcuaacaaugaagucauggcccucgagccgguugugggggccgcuaucgccgcucccguggccggacagcaaaacgucauugacccuuggaucagaaauaacuucgugcaggcgcccggcggggaauuuaccguuuccccucggaaugcccccggagagauucuguggucugcuccucuuggcccggaucugaaccccuaccucagccaccuggcccgcauguauaauggguacgcuggaggcuucgaagugcaggucauccuugccggcaacgcguuuacagccgggaaagugauuuucgcugccguuccucccaauuuuccuacggagggacugucccccucucaggugaccauguucccgcauaucgucguggacgugagacaacucgagccuguccugaucccccugccugauguucggaacaauuuuuaucacuacaaccagagcaaugaccccacaauuaagcucaucgcuaugcuguauacaccccuucgcgccaacaacgccggcgaugacguguucaccguguccugcagaguccugacccggccuagcccggauuuugacuucauuuuucucgugcccccuacaguugaaucucgcaccaaacccuucuccgugccuguccugacgguggaggaaaugaccaauagcagauuucccaucccgcuugagaagcuguucacagggccuucuuccgcuuucguugugcagccccagaacggacgguguaccacagauggcguccuccuggggaccacgcaacugagcccugugaauauuugcacauuucgcggagacgucacccauaucacaggcucuagaaacuacaccaugaaucucgcgucccagaacuggaauaacuaugaucccaccgaggaaauuccugcuccccugggcacaccggacuucguggggaaaauccagggaaugcuuacgcagaccacacgggccgacggcagcacccgcgggcacaaggccacaguuuacaccggauccgccgauuuuucuccuaagcugggcagagugcaauucgagacggacacagaucaugacuuugaagcuaaucagaacaccaaauucacccccgucggggugauccaggauggaagcacaacccaccggaaugagccccaacaguggguucucccuuccuacagcggccgcaacacacacaaugugcaucuggccccggcggucgcucccacguuuccuggcgaacagcuucuguucuuuagaucuaccaugcccggguguuccggauauccuaacauggaccucgauugccugcugccccaggagugggugcaauacuucuaucaggaggccgccccugcucagagcgacguggcccuccugcgguuuguuaaucccgauacaggcagaguccuuuucgaauguaagcugcacaaaucuggguacgugaccguggcucauacaggacagcacgaccucgucauuccgccuaacggcuauuuucgcuucgauagcugggugaaccaauucuacacccuggcccccauggggaauggcacgggacggaagagaguuuga

SEQ ID NO: 29083 - RNA, 1620 nt, Artificial Sequence
  derived and/or modified sequence opt5 from VP1__Norovirus_and/or_Norovirus-like__KX354094
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaucuaccacacaccggaaugagccccaacaguggguccucccuagcuacuccggccgcaacacgcacaaugugcaucuggcuccggccguggcgcccaccuuuccuggcgaacagcuucuguucuuuagaagcacaaugcccggguguucuggauauccuaacauggaccucgauugccugcugccccaggaguggguucaauacuucuaucaggaggcugccccugcccaguccgacgucgcucuccugcgguuugugaaucccgauaccggcagagugcuuuucgaauguaagcugcacaaaagcggguacgucacaguggcccauaccggacagcacgaccucguuauuccgccuaacggcuauuuucgcuucgauucuugggugaaccaauucuacacgcuggcucccauggggaauggcaccggacggagacgcgucuga

SEQ ID NO: 29084 - RNA, 1620 nt, Artificial Sequence
  derived and/or modified sequence opt5 from VP1__Norovirus_and/or_Norovirus-like__KX354058
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucgcuggcucuagaaacuacacaaugaaucucgcgucccagaacuggaauaacuaugaucccaccgaggaaauuccugcuccccugggcaccccggacuucguugggaaaauccagggaaugcuuacacagacgacccggacagacggcagcacccgcgggcacaaggccacaguguacaccggauccgccgaguuugccccuaagcugggcagaguccaauucgaaacggauacagaccaugauuuugagaccaaucagaacaccaaauucacacccguggggguuauccaggacggaucuaccacacaccggaaugaaccccaacagugggugcucccuagcuacuccggccgcaacacgcacaauguccaucuggcuccggccguggcgcccaccuuuccuggcgagcagcuucuguucuuuagaagcacaaugcccggguguucuggauauccuaacauggaucucgacugccugcugccccaggagugggugcaauacuucuaucaggaagcugccccugcccaguccgauguugcucuccugcgguuugucaaucccgacaccggcagagugcuuuucgaguguaagcugcacaaaagcggguacgugacagucgcccauaccggacagcacgaucucgugauuccgccuaacggcuauuuucgcuucgacucuuggguuaaccaauucuacacgcuggcucccauggggaauggcaccggacggagacgcguguga

SEQ ID NO: 29085 - RNA, 1620 nt, Artificial Sequence
  derived and/or modified sequence opt5 from VP1__Norovirus_and/or_Norovirus-like__KX354057
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggaaugcuuacgcagaccacacggaccgacggcagcacacgcgggcacaaggccaccguguacacgggauccgcugaguuugccccuaagcugggcagaguccaauucgaaacagauaccgaccaugauuuugagaccaaucagaacacaaaauucacccccguggggguuauccaggacggaucuacaacgcaccggaaugaaccccaacagugggugcucccuagcuacuccggccgcaacacccacaauguccaucuggccccggcuguggcccccacauuuccuggcgagcagcuucuguucuuuagaagcaccaugcccggguguucuggauauccuaacauggaucucgacugccugcugccccaggagugggugcaauacuucuaucaggaagcggcuccugcccaguccgauguugcccuccugcgguuugucaaucccgacacaggcagagugcuuuucgaguguaagcugcacaaaagcggguacgugaccgucgcucauacgggacagcacgaucucgugauuccgccuaacggcuauuuucgcuucgacucuuggguuaaccaauucuacacccuggcccccauggggaauggcacaggacggagacgcguguga

SEQ ID NO: 29086 - RNA, 1620 nt, Artificial Sequence
  derived and/or modified sequence opt5 from VP1__Norovirus_and/or_Norovirus-like__KX354034
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauuggaacaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgcacaacgugcaucuggcuccggccguggcgcccaccuuuccuggggaacagcuucuguucuuuagaagcacaaugcccggauguucuggcuauccuaauauggaccucgauugccugcugccccaggaguggguucaauacuucuaucaggaggcugccccugcccaguccgacgucgcucuccugcgguuugugaaccccgauaccgggagagugcuuuucgaauguaagcugcacaaaagcggauacgucacaguggcccauaccggccagcacgaccucguuauuccgccuaauggguauuuucgcuucgauucuugggugaaccaauucuacacgcuggcucccaugggcaacggaaccggccggagacgcgucuga

SEQ ID NO: 29087 - RNA, 1620 nt, Artificial Sequence
  derived and/or modified sequence opt5 from VP1__Norovirus_and/or_Norovirus-like__KX354027
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauacaaccggcucuagaaacuacaccaugaaucucgcuucccagaacuggaauaacuaugaucccacagaggaaaucccugcgccccugggcgccccggacuucguugggaaaauucagggaaugcuuacgcagaccacacgggcugacggcagcacccgcgggcacaaggccacaguguacaccggauccgccgauuuugcuccuaagcugggcagaguccaauucgagacggacacagaucaugacuuugaagccaaucagaacaccaaauucacccccguggggguuauccaggauggaucuacaacccaccggaaugagccccaacagugggugcucccuagcuacuccggccgcaacacacacaauguccaucuggcgccggcuguggcccccacguuuccuggcgaacagcuucuguucuuuagaagcaccaugcccggguguucuggauauccuaacauggaccucgauugccugcugccccaggagugggugcaauacuucuaucaggaggccgcuccugcccaguccgacguugcucuccugcgguuugucaaucccgauacaggcagagugcuuuucgaauguaagcugcacaaaagcggguacgugaccgucgcccauacaggacagcacgaccucgugaucccgccuaacggcuauuuucgcuucgauucuuggguuaaccaauucuacacccuggcgcccauggggaauggcgccggacggagacgcguguga

SEQ ID NO: 29088 - RNA, 1620 nt, Artificial Sequence
  derived and/or modified sequence opt5 from VP1__Norovirus_and/or_Norovirus-like__KX354025
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacgggccgacggcagcacccgcgggcacaaggcuacagucuacaccggauccgccgauuuugccccuaagcugggcagagugcaauucgagacggacacagaucaugacuuugaagcuaaucagaacaccaaauucacccccguuggggugauccaggauggaggcacaacccaccggaaugagccccaacaguggguccucccuucuuacagcggccgcaacacacacaaugugcaucuggccccggcgguggcucccacguuuccuggggaacagcuucuguucuuuagauccaccaugcccggauguagcggcuauccuaacauggaccucgauugccugcugccccaggaguggguucaauacuucuaucaggaggccgccccugcucagucugacgucgcccuccugcgguuugugaaucccgauacagggagagugcuuuucgaauguaagcugcacaaauccggauacgucaccguggcucauacaggccagcacgaccucguuauuccgccuaacggguauuuucgcuucgauagcugggugaaccaauucuacacccuggcccccaugggcaauggaacgggccggagacgcgucuga

SEQ ID NO: 29089 - RNA, 1620 nt, Artificial Sequence
  derived and/or modified sequence opt5 from VP1__Norovirus_and/or_Norovirus-like__KJ685406
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggaggcugccccugcccagucugacgucgcucuccugcgguuugugaaucccgauaccgggagagugcuuuucgaauguaagcugcacaaauccggauacgucacaguggcccauaccggccagcacgaccucguuauuccgccuaacggguauuuucgcuucgauagcugggugaaccaauucuacacgcuggcucccaugggcaauggaaccggccggagacgcgucuga

SEQ ID NO: 29090 - RNA, 1620 nt, Artificial Sequence
  derived and/or modified sequence opt5 from VP1__Norovirus_and/or_Norovirus-like__KF008241
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucucuauuugcacauuucgcggagacgugacccauaucacaggcuccagaaauuacaccaugaaccucgcuagccagaauuggaacaauuaugaucccaccgaggaaauuccugcgccccugggcacaccggacuucguugggaaaauccagggaaugcuuacgcagaccacacgggccgacggcuccacccgcgggcacaaggcuacaguguacaccggaucugccgauuuugccccuaagcugggcagaguccaauucgagacggacacagaucaugacuuugaagcuaaccagaauaccaaauucacccccguggggguuauccaggauggaagcacaacccaccggaacgagccccaacagugggugcucccuuccuacagcggccgcaauacacacaacguccaucuggccccggcgguggcucccacguuuccuggcgaacagcuucuguucuuuagaucuaccaugcccggguguuccggauauccuaauauggaccucgauugccugcugccccaggagugggugcaauacuucuaucaggaggccgccccugcucagagcgacguugcccuccugcgguuugucaaccccgauacaggcagagugcuuuucgaauguaagcugcacaaaucuggguacgugaccgucgcucauacaggacagcacgaccucgugauuccgccuaauggcuauuuucgcuucgauagcuggguuaaccaauucuacacccuggcccccauggggaacggcacgggacggagacgcguguga

SEQ ID NO: 29091 - RNA, 1620 nt, Artificial Sequence
  derived and/or modified sequence opt5 from VP1__Norovirus_and/or_Norovirus-like__AB504327
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucgguccgcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacacgcuucacccccgugggagucauucaggacggcggcacaacgcacagaaaugaaccccagcaaugggugcugccuuccuacagcgggcggaacguuccgaaugugcaccuugcccccgcugucgccccuaccuuucccggagagcagcuccuguucuuucgcucuacaaugccuggcuguuccggguaucccaacauggaucuggacugccugcucccucaggagugggugcagcauuucuaccaagaagcggcucccgcccagagcgauguggcccugcuuagauuuguuaauccggacaccggacggguccuguucgaguguaagcuccacaaaucuggcuaugugacaguggcucauaccgggcagcacgaucuggucaucccucccaacggcuacuuuagauucgacagcugggugaaccaguucuauacgcuugccccuaugggaaauggcaccgggcgccggagaguuuga

SEQ ID NO: 29092 - RNA, 1620 nt, Artificial Sequence
  derived and/or modified sequence opt5 from VP1__Norovirus_and/or_Norovirus-like__KY424329
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccugugcugacggucgaggaaaugaccaauagcagauuucccaucccgcuugagaagcuguucacagggccuucuuccgccuucgugguucagccccagaacggacgguguaccacagauggcgugcuccuggggaccacgcaacugagcccugucaauauuugcaacuuucgcggagacgugacacauaucaccggcucuagaaauuacacaaugaaccucgcuucccagaauuggaacaauuaugaucccaccgaggaaaucccugcgccccugggcaccccggacuucgucgggaaaauucagggaaugcuuacacagacgacccggacagacggcagcacccgcgggcacaaggccacaguguacaccggauccgcugauuuugccccuaagcugggcagaguucaauucgagacggacacagaucaugacuuugaagccaaccagaauaccaaauucacccccgugggggucauccaggauggaucuacaacccaccggaacgagccccaacagugggugcucccuagcuacuccggccgcaauacacacaacguucaucuggcuccggccguggcgcccacguuuccuggcgaacagcuucuguucuuuagaagcaccaugcccggguguucuggauauccuaauauggaccucgauugccugcugccccaggaguggguccaauacuucuaucaggaggcugccccugcccaguccgacguggcucuccugcgguuugugaaccccgauacaggcagaguucuuuucgaauguaagcugcacaaaagcggguacgucaccguggcccauacaggacagcacgaccucgugauuccgccuaacggcuauuuucgcuucgauucuugggucaaucaauucuacacccuggcucccauggggaacggcacgggacggagacgcguguga

SEQ ID NO: 29093 - RNA, 1620 nt, Artificial Sequence
  derived and/or modified sequence opt5 from VP1__Norovirus_and/or_Norovirus-like__KT780389
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcgccccggacuucguugggaaaauccagggagugcuuacacagacgacccgggcugacggcagcacacgcgggcacaaggccaccgucuacacaggauccgccgauuuugcuccuaagcugggcagagugcaauucgagaccgacacggaucaugacuuugaagccaaucagaacacaaaauucacccccguuggggugauccaggauggaucuaccacacaccggaaugagccccaacaguggguccucccuagcuacuccggccgcaacacccacaaugugcaucuggcgccggcuguggcccccacauuuccuggcgaacagcuucuguucuuuagaagcacgaugcccggguguucuggauauccuaacauggaccucgauugccugcugccccaggaguggguucaauacuucuaucaggaggccgcuccugcccaguccgacgucgcucuccugcgguuugugaaucccgauaccggcagagugcuuuucgaauguaagcugcacaaaagcggguacgucacaguggcccauaccggacagcacgaccucguuauuccgccuaacggcuauuuucgcuucgauucuugggugaaccaauucuacacacuggcgcccauggggaauggcgccggacggaagagagucuga

SEQ ID NO: 29094 - RNA, 1620 nt, Artificial Sequence
  derived and/or modified sequence opt5 from VP1__Norovirus_and/or_Norovirus-like__KX354134
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccauccugacgguggaggaaaugaccaauucuagauuuccuauuccccuugagaagcuguucacagggccguccagcgccuucgucgugcagccucagaacggacgguguaccacagauggcguucuccuggggaccacgcaacugucucccgugaauaucugcacauuucgcggagacaucacccauauuacaggcucccacaacuacaccaugaaucucgcuagccagaacuggaacuccuaugauccuaccgaggaaauccccgcgccucugggcacacccgacuucgucgggaaaauucagggagugcuuacgcagaccacaagagccgacggcucuacccgggggcauaaggcuacagucuacaccggaagcgccgauuuugccccgaagcugggccgcgugcaauucgagacggacacaaaucacgauuuugaagcuaaucagaacaccaaauucaccccuguuggggugauccaggacggauccacaacccacagaaaugagccccaacaguggguccuccccagcuacucuggccggaacacacauaaugugcaccuggccccugcgguugcuccgacguuucccggcgaacagcuucuguucuuucgcuccaccaugccuggguguagcggauaucccaacauggaucucgacugccugcugccucaggagugggugcaauucuuuuaccaggaggccgcccccgcucagucugaugucgcccuccugagauucgugaauccugacacaggccgggugcuuuuugaauguaagcugcauaaaagcggguauguuaccgucgcucacacaggacagcacgaucucgugauucccccgaacggcuacuucagauucgacuccugggugaaccaauuuuauacccuggccccuauggggaauggcacgggacgccggagagucuga

SEQ ID NO: 29095 - RNA, 1620 nt, Artificial Sequence
  derived and/or modified sequence opt5 from VP1__Norovirus_and/or_Norovirus-like__KX354126
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggaaugcuuacgcagaccacacgggccgacggcagcacccgcgggcacaaggcuacaguguacaccggauccgccgauuuuucuccuaagcugggcagaguccaauucgagacggacacagaucaugacuuugaagccaaucagaacaccaaauucacccccguggggguuauccaggauggaagcacaacccaccggaaugagccccaacagugggugcucccuuccuacagcggccgcaacacacacaauguccaucuggcuccggccguggcgcccacguuuccuggcgaacagcuucuguucuuuagaucuaccaugcccggguguuccggauauccuaacauggaccucgauugccugcugccccaggagugggugcaauacuucuaucaggaggcugccccugcccagagcgacguugcucuccugcgguuugucaaucccgauacaggcagagugcuuuucgaauguaagcugcacaaaucuggguacgugaccgucgcccauacaggacagcacgaccucgugauuccgccuaacggcuauuuucgcuucgauagcuggguuaaccaauucuacacccuggcucccauggggaauggcacgggacggaagagaguguga

SEQ ID NO: 29096 - RNA, 1620 nt, Artificial Sequence
  derived and/or modified sequence opt5 from VP1__Norovirus_and/or_Norovirus-like__KR904237
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagagauaauuucguucaggcccccggcggggaauuuaccguguccccucggaacgcgcccggagagauucuguggucugccccucuuggcccggaccugaaucccuaccucagccaccuggcucgcauguauaacggguacgccggaggcuucgaaguccaggugauccuugcuggcaaugccuuuacagcggggaaaguuauuuucgccgcugugccucccaacuuuccuacggagggacugucccccucucaggucaccauguucccgcauaugaucguggaugugagacaacucgagccuguccugaucccccugccugacguucggaauaacuuuuaucacuacaaucagagcaacgaucccacacucaagcugauugccaugcuuuauacaccccugcgcgcuaauaacgccggcgacgauguguucaccguguccugcagaguccucacccggccuagcccggacuuugauuucaucuuucuggugcccccuacaguugaaucucgcaccaaacccuucuccgugccuguccuuacgguggaggaaaugaccaacagcagauuucccauuccgcuggagaagcuguucacagggccuucuuccgccuucguugugcagccccagaauggacgguguaccacagacggcguccugcuggggaccacgcaacucagcccugugaacaucugcacauuucgcggagaugucacccauauuacaggcucuagaaauuacaccaugaaccuggcuucccagaauuggaacaauuaugaccccaccgaggaaaucccugcgccccuuggcgccccggacuucguggggaaaauucagggaaugcugacacagacgacccggacagauggcagcacccgcgggcacaaggcuacaguuuacaccggauccgccgacuuugccccuaagcucggcagagugcaauucgagacggauacagaccaugauuuugaagcuaaccagaauaccaaauucacccccgucggggugauccaggacggaucuacaacccaccggaacgagccccaacaguggguucugccuagcuacuccggccgcaauacacacaacgugcaucuugccccggcggucgcucccacguuuccuggcgaacagcuccucuucuuuagaagcaccaugcccggguguucuggauauccuaauauggaucuggacugccugcucccccaggagugggugcaauacuucuaucaggaggccgccccugcucaguccgauguggcccugcuucgguuuguuaaccccgacacaggcagaguccuguucgaauguaagcuccacaaaagcggguacgugaccguggcucauacaggacagcacgaucuggucaucccgccuaauggcuauuuucgcuucgacucuugggugaaccaauucuacacccuugcccccauggggaacggcacgggacggagacgcauuuga

SEQ ID NO: 29097 - RNA, 1620 nt, Artificial Sequence
  derived and/or modified sequence opt5 from VP1__Norovirus_and/or_Norovirus-like__KP241911
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggaaugcuuacgcagaccacacggaccgacggcagcacacgcgggcacaaggccaccguguacacgggauccgcugauuuugccccuaagcugggcagaguccaauucgagacagacaccgaucaugacuuugaagccaaucagaacaccaaauucacacccguggggguuauccaggauggaucuaccacacaccggaaugagccccaacagugggugcucccuagcuacuccggccgcaacacgcacaauguccaucuggcuccggccguggcgcccaccuuuccuggcgaacagcuucuguucuuuagaagcacaaugcccggguguucuggauauccuaacauggaccucgauugccugcugccccaggagugggugcaauacuucuaucaggaggcugccccugcccaguccgacguugcucuccugcgguuugucaaucccgauaccggcagagugcuuuucgaauguaagcugcacaaaagcggguacgugacagucgcccauaccggacagcacgaccucgugauuccgccuaacggcuauuuucgcuucgauucuuggguuaaccaauucuacacgcuggcucccauggggaauggcaccggacggagacgcguguga

SEQ ID NO: 29098 - RNA, 1620 nt, Artificial Sequence
  derived and/or modified sequence opt5 from VP1__Norovirus_and/or_Norovirus-like__KJ685411
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccugaacuggaauaacuaugaucccaccgaggaaauuccugcgccccuuggcacaccggacuucguugggaaaauccagggaaugcugacgcagaccacacggaccgacggcagcacacgcgggcacaaggccaccguguacacgggauccgcugauuuugccccuaagcucggcagaguccaguucgagacagacaccgaucaugacuuugaagccaaucaaaacaccaaauucacacccguggggguuauccaggauggaucuaccacacaccggaaugagccccagcaaugggugcugccuagcuacuccggccgcaacacgcacaauguccaucuugcuccggccguggcgcccaccuuuccuggcgaacagcuccuguucuuuagaagcacaaugcccggguguucuggauauccuaacauggaccuggauugccugcucccccaggagugggugcaguacuucuaucaagaggcugccccugcccaguccgacguugcucugcuucgguuugucaaucccgauaccggcagagugcuguucgaauguaagcuccacaaaagcggguacgugacagucgcccauaccggacagcacgaccuggugauuccgccuaacggcuauuuucgcuucgauucuuggguuaaccaguucuacacgcuugcucccauggggaauggcaccggacggagacgcguguga

SEQ ID NO: 29099 - RNA, 1620 nt, Artificial Sequence
  derived and/or modified sequence opt5 from VP1__Norovirus_and/or_Norovirus-like__KF008242
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaucuaccacacaccggaaugagccccaacaguggguccucccuagcuacuccggccgcaacacgcacaaugugcaucuggcuccggccguggcgcccaccuuuccuggcgaacagcuucuguucuuuagaagcacaaugcccggguguucuggauauccuaacauggaccucgauugccugcugccccaggaguggguucaauacuucuaucaggaggcugccccugcccaguccgacgucgcucuccugcgguuugugaaucccgauaccggcagagugcuuuucgaauguaagcugcacaaaagcggguacgucacaguggcccauaccggacagcacgaccucguuauuccgccuaacggcuauuuucgcuucgauucuugggugaaccaauucuacacgcuggcucccauggggaauggcaccggacggaagagagucuga

SEQ ID NO: 29100 - RNA, 1620 nt, Artificial Sequence
  derived and/or modified sequence opt5 from VP1__Norovirus_and/or_Norovirus-like__KF060112
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcgccccggacuucguugggaaaauccagggaaugcuuacacagacgacccggacagacggcagcacccgcgggcacaaggcuacaguguacaccggauccgccgauuuugccccuaagcugggcagaguccaauucgagacggacacagaucaugacuuugaagcuaaucagaacaccaaauucacccccguggggguuauccaggauggaucuacaacccaccggaaugagccccaacagugggugcucccuagcuacuccggccgcaacacacacaauguccaucuggccccggcgguggcucccacguuuccuggcgaacagcuucuguucuuuagaagcaccaugcccggguguucuggauauccuaacauggaccucgauugccugcugccccaggagugggugcaauacuucuaucaggaggccgccccugcucaguccgacguugcccuccugcgguuugucaaucccgauacaggcagagugcuuuucgaauguaagcugcacaaaagcggguacgugaccgucgcucauacaggacagcacgaccucgugauuccgccuaacggcuauuuucgcuucgauucuuggguuaaccaauucuacacccuggcccccauggggaauggcacgggacggagacgcguguga

SEQ ID NO: 29101 - RNA, 1620 nt, Artificial Sequence
  derived and/or modified sequence opt5 from VP1__Norovirus_and/or_Norovirus-like__JX126912
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacagcuacgcugggggauucgaaguccaggugauccuugccggcaaugcuuuuacggccggcaaaauuaucuucgcggccguuccucccaacuuuccuaccgaggggcugucccccucucaggugacaauguucccgcauaucauugucgacgugagacaacucgagccugugcugaucccccugccugauguccggaauaacuuuuaucacuacaaucagagcaacgaccccaccauuaagcucaucgcuaugcuguauacaccccuucgcgccaacaaugcuggagaagauguuuucaccguguccugcagagugcugacacggccuagcccggacuuugauuucauuuuucucgugcccccuaccgucgagucucgcacgaaacccuucaccguuccuauccugacaguggaagagaugaccaacuccagauuucccauuccgcuugagaagcuguucacaggcccuagcggggccuucgucgugcagccccagaauggacgguguaccacggacggcguucuccuggggacaacccaacugucuccugugaacaucugcacauuucgcggagaugucacccauaucgccggcacccacaauuacacaaugaaccucgcuucccagaauuggaacaauuaugaccccacggaagagauuccugcgccccugggcaccccggauuucguggggagaauccagggaaugcuuacacagaccacacggggcgacgggagcacccgcggacauaaagccacggucucuacaggcgacgugcacuuuaccccuaagcugggguccauucaauucaacaccgauacaaauaacgacuuugaaaccggacagaauacaaaguucacgcccguuggcgugauccaggauggcaacgggacccaccaaaaugagccccagcaguggguccucccuagcuacuccggaagaacaggccauaacgugcaccuggcuccggccguugcccccaccuuuccuggggaacagcuucuguucuuucggucuacaaugcccggauguagcggcuacccuaacaugaaucucgacugccugcugccccaagagugggugcagcauuucuaucaggaggcugccccugcgcaguccgaugucgcucuccugcgcuuugugaaccccgacaccgggagagugcuuuucgaauguaaacugcacaagagcggcuacguuacggucgcccacaccggacaacaugaucucgugauuccgccuaauggcuauuuucgguucgacucuugggugaaccaguucuacacacuggcccccauggggaauggaaccggcagacgccgggucuga

SEQ ID NO: 29102 - RNA, 1620 nt, Artificial Sequence
  derived and/or modified sequence opt5 from VP1__Norovirus_and/or_Norovirus-like__KX354143
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaucguguacaccggaucugcugauuuugccccgaagcugggcagaguucaauucgagacggacacagaucaugacuuugaagccaaucagaacaccaaauucaccccugugggggucauucaggauggaagcacaacccaccggaaugagccccaacagugggugcuccccuccuacagcggccgcaacacacacaauguucaucuggcuccugccguggcgccgacguuucccggcgaacagcuucuguucuuuagaucuaccaugccuggguguuccggauaucccaacauggaccucgauugccugcugccucaggaguggguccaauacuucuaucaggaggcugcccccgcccagagcgacguggcucuccugcgguuugugaauccugauacaggcagaguucuuuucgaauguaagcugcacaaaucuggguacgucaccguggcccauacaggacagcacgaccucgugauucccccgaacggcuauuuucgcuucgauagcugggucaaccaauucuacacccuggcuccuauggggaauggcacgggacggagacgcguguga

SEQ ID NO: 29103 - RNA, 1620 nt, Artificial Sequence
  derived and/or modified sequence opt5 from VP1__Norovirus_and/or_Norovirus-like__KU985164
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcgccccggacuucguugggaaaauccagggaaugcuuacacagacgacccgggcugacggcagcacacgcgggcacaaggccaccguguacacaggauccgccgauuuugcuccuaagcugggcagaguccaauucgagaccgacacggaucaugacuuugaagccaaucagaacacaaaauucacccccguggggguuauccaggauggaucuaccacacaccggaaugagccccaacagugggugcucccuagcuacuccggccgcaacacccacaauguccaucuggcgccggcuguggcccccacauuuccuggcgaacagcuucuguucuuuagaagcacgaugcccggguguucuggauauccuaacauggaccucgauugccugcugccccaggagugggugcaauacuucuaucaggaggccgcuccugcccaguccgacguugcucuccugcgguuugucaaucccgauaccggcagagugcuuuucgaauguaagcugcacaaaagcggguacgugacagucgcccauaccggacagcacgaccucgugauuccgccuaacggcuauuuucgcuucgauucuuggguuaaccaauucuacacacuggcgcccauggggaauggcgccggacggagacgcguguga

SEQ ID NO: 29104 - RNA, 1620 nt, Artificial Sequence
  derived and/or modified sequence opt5 from VP1__Norovirus_and/or_Norovirus-like__KX950760
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugcuucuggcuggcaacgccuuuacagcggggaaaguuaucuucgccgcugugccucccaauuuuccuacggagggacucucccccucucaggucaccauguucccgcauauugugguggacgucagacaacuggagccuguucugaucccccucccugaugugcggaacaauuuuuaucacuacaaccagagcaaugacuccacaaucaagcugauugccaugcuuuauacaccccugcgcgcuaacaacgccggcgaugacguguucaccgucagcugcagagugcucacccggcccucuccugauuuugacuucaucuuucugguuccgcccacaguggaaucccgcaccaaaccuuucagcauucccguccuuacgguggaggaaaugaccaauucuagauuuccuaucccccuggagcggcuguucacagggccguccagcgccuucguugugcagccucagaacggacgcuguaccacagauggcguccugcuggggaccacgcaacucucucccgugaauauuugcacauuuagaggagacgucacccauaucacaggcucccggaacuacaccaugaaucuggcuagccagaacuggaauaacuaugauccuaccgaggaaauucccgcgccucuuggcacacccgacuucguggggaagauccagggaaugcugacgcagaccacacgcgccaauggcuccaccagagggcacaaagcuacaguuuacaccggaucugccgacuuugccccgaagcucggccgggugcaauucgagacggauacaagcgacgauuuugaaaccucccagaacaccaaguucacaccugucggggugauccaggacggaagcaccacaccccgcaaugagccccaacaguggguucugccuucuuacuccggcagaaacacgcauaaugugcaccuugcuccggccgucgcgcccaccuuuccuggcgaacagcuccucuucuuucggagcauuaugcccggguguucuggauauccuaacauggaucuggacugccugcucccccaggagugggugcaacacuucuaccaggaggcugccccugcccagagcgauguggcucugcuuagauuuguuaaucccgacacaggccgcguccuguucgaauguaaacuccauaaguccggguaugugaccguggcccacacaggacagcaugaucuggucaucccgccuaacggcuacuuucgguucgacucuugggugaaccaauucuauacccuugcucccauggggaauggcacgggaagacgccggguuuga

SEQ ID NO: 29105 - RNA, 1620 nt, Artificial Sequence
  derived and/or modified sequence opt5 from VP1__Norovirus_and/or_Norovirus-like__KJ685402
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuggagccuucgugguccagccccagaacggccgguguaccacagauggggugcuccugggaaccacgcaacuguccccugucaauauuugcacauuucgcggcgacgugacccauaucacaggcagcagaaacuacaccaugaaucucgcuucucagaacuggaauaacuaugaucccaccgaggaaauuccugcgccccuggggacaccggacuucguuggaaaaauccagggcaugcuuacgcagaccacacggaccgacggguccacacgcggacacaaggccaccguguacacgggcagcgcugauuuugccccuaagcuggggagaguccaauucgagacagacaccgaucaugacuuugaagccaaucagaacaccaaauucacacccgugggaguuauccaggauggcuccaccacacaccggaaugagccccaacagugggugcucccuucuuacagcggccgcaacacgcacaauguccaucuggcuccggccguggcgcccaccuuuccuggggaacagcuucuguucuuuagauccacaaugcccggauguagcggcuauccuaacauggaccucgauugccugcugccccaggagugggugcaauacuucuaucaggaggcugccccugcccagucugacguugcucuccugcgguuugucaaucccgauaccgggagagugcuuuucgaauguaagcugcacaaauccggauacgugacagucgcccauaccggccagcacgaccucgugauuccgccuaacggguauuuucgcuucgauagcuggguuaaccaauucuacacgcuggcucccaugggcaauggaaccggccggagacgcguguga

SEQ ID NO: 29106 - RNA, 1620 nt, Artificial Sequence
  derived and/or modified sequence opt5 from VP1__Norovirus_and/or_Norovirus-like__KF060140
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauauucggaacaauuuuuaucacuacaaccagagcaaugacuccacaaucaagcucauugccaugcuguauacaccccuucgcgcuaacaacgccggcgaugacgucuucaccguuagcugcagagugcugacccggcccucuccugauuuugacuucaucuuucucgugccgcccacagucgaaucccgcaccaaaccuuucagcgugcccguucugacgguggaggaaaugaccaauucuagauuuccuauuccccuugagaagcuguucacagggccguccagcgccuucgucgugcagccucagaacggacgguguaccacagauggcguucuccuggggaccacgcaacugucucccgugaauaucugcacauuucgcggagacgucacccauaucacaggcuccagaaacuacaccaugaaucucgcuagccagaacuggaauaacuaugauccuaccgaggaaauucccgcgccucugggcacacccgacuucguggggaaaauccagggaguccuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauucaggauggaagcaccacacaccggaaugagccccaacagugggugcuccccuccuacagcggccgcaacacgcacaauguucaucuggcuccugccguggcgccgaccuuucccggcgaacagcuucuguucuuuagaucuacaaugccuggguguuccggauaucccaacauggaccucgauugccugcugccucaggaguggguccaauacuucuaucaggaggcugcccccgcccagagcgacguggcucuccugcgguuugugaauccugauaccggcagaguucuuuucgaauguaagcugcacaaaucuggguacgucacaguggcccauaccggacagcacgaccucgugauucccccgaacggcuauuuucgcuucgauagcugggucaaccaauucuacacgcuggcuccuauggggaauggcaccggacggagacgcguguga

SEQ ID NO: 29107 - RNA, 1620 nt, Artificial Sequence
  derived and/or modified sequence opt5 from VP1__Norovirus_and/or_Norovirus-like__KX354132
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagcucaaugacagcacaauuaagcugaucgccaugcuuuauacaccccugcgcgcuaacaacgccggcgaugacguuuucaccguguccugcagagugcucacccggcccagcccugauuuugacuucauuuuucuggucccgcccacaguggaaucucgcaccaaaccuuucuccguucccauccuuacgguggaggaaaugaccaauagcagauuuccuauuccccuggagaagcuguucacagggccgucuuccgccuucgucgugcagccucagaacggacgguguaccacagauggcguucugcuggggaccacgcaacucagccccgugaauaucugcacauuucgcggagacaucacccauacaaccggcucucacaacuacaccaugaaucuggcuucccagaacuggaauagcuaugauccuacagaggaaauucccgcgccucuuggcacgcccgacuucgucgggaaaauccagggagugcugacccagacaaccagagccgacggcuccacacgggggcauaaggcuaccgucuacacgggaucugccgauuuugccccgaagcucggccgcgugcaauucgagacagacaccaaccacgauuuugaagcuaaucagaacaccaaauucacaccuguuggggugauucaggacggaggcaccacacacagaaaugagccccaacaguggguccugcccagcuacuccggccggaacacgcauaaugugcaccuugccccugcgguugcuccgaccuuucccggggaacagcuccucuucuuucgcagcacaaugccuggauguucuggcuaucccaacauggaucuggacugccugcucccucaggagugggugcaauucuuuuaccaggaggccgcccccgcucaguccgaugucgcccugcuuagauucgugaauccugacaccgggcgggugcuguuugaauguaagcuccauaaaagcggauauguuacagucgcucacaccggccagcacgaucuggugauucccccgaacggguacuucagauucgacucuugggugaaccaauuuuauacgcuugccccuaugggcaauggaaccggccgccggagagucuga

SEQ ID NO: 29108 - RNA, 1620 nt, Artificial Sequence
  derived and/or modified sequence opt5 from VP1__Norovirus_and/or_Norovirus-like__KX354006
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaguuccugcgccccugggcacaccggacuucguggggaaaauucagggaaugcuuacgcagaccacacggaccgacggcagcacacgcgggcacaaggccaccgucuacacgggauccgcugauuuuacaccuaagcugggcagaauccaauucgagaccgacaccgaucaugacuuugaagccaaucagaacacaaaauucacccccguggggguuauccaggauggaucuacaacgcaccggaaugagccccaacagugggugcucccuagcuacuccggccgcaacacccacaauguccaucuggccagcgcuguggccccgacauuucccggcgaacagcuucuguucuuuagaucuaccaugccuggguguuccggauaucccaacauggaccucgauugccugcugccucaggagugggugcaauacuucuaucaggaggcggcucccgcccagagcgacguugcccuccugcgguuugucaauccugauacaggcagagugcuuuucgaauguaagcugcacaaaucuggguacgugaccgucgcuuauacgggacagcaugaccucgugauucccccgaacggcuacuuucgcuucgauagcuggguuaaccaauucuauacccuggccccuauggggaauggcacaggacggagacgcguguga

SEQ ID NO: 29109 - RNA, 1620 nt, Artificial Sequence
  derived and/or modified sequence opt5 from VP1__Norovirus_and/or_Norovirus-like__KX354145
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauccaggauggaagcaccacacaccggaaugagccccaacagugggugcuccccuccuacagcggccgcaacacgcacaauguucaucuggcuccugccguggcgccgaccuuucccggcgaacagcuucuguucuuuagaucuacaaugccuggguguuccggauaucccaacauggaccucgauugccugcugccucaggaguggguccaauacuucuaucaggaggcugcccccgcccagagcgacguggcucuccugcgguuugugaauccugauaccggcagaguucuuuucgaauguaagcugcacaaaucuggguacgucacaguggcccauaccggacagcacgaccucgugauucccccgaacggcuauuuucgcuucgauagcugggucaaccaauucuacacgcuggcuccuauggggaauggcaccggacggagacgcguguga

SEQ ID NO: 29110 - RNA, 1620 nt, Artificial Sequence
  derived and/or modified sequence opt5 from VP1__Norovirus_and/or_Norovirus-like__KX354140
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucaguccaacgacagcacaauuaagcucaucgccaugcuguauacaccccuucgcgcuaauaacgccggcgaugacguuuucaccgugucuugcagagugcugacccggcccuccccugauuuugacuucauuuuucucgucccgcccacaguggaaagccgcaccaaaccuuucucuguucccgugcugacggucgaggaaaugaccaacuccagauuuccuaucccccuugagaagcuguucacagggccgagcucugccuucgugguucagccucagaauggacgguguaccacagauggcgugcuccuggggaccacgcaacugucccccgucaacauuugcacauuucgcggagacgugacccauaucacaggcagcagaaauuacaccaugaaccucgcuucccagaauuggaacaauuaugauccuaccgaggaaauccccgcgccucuggccacacccgacuucgucggcaaaauucaggggaugcuuacgcagaccacacggaccgacggaucuacacgcggccacaaggcuaccguguacacggggagcgccgauuuugccccgaagcugggaagaguucaauucgagacagacaccgaucaugacuuugaagcuaaccagaauaccaaauucacaccugugggcgucauccaggauggguccaccacacaccggaacgagccccaacagugggugcuccccagcuacucuggacgcaauacgcacaacguucaucuggccccugcgguggcuccgaccuuucccggcgaacagcuucuguucuuuagauccacaaugccuggcuguagcggguaucccaauauggaccucgauugccugcugccucaggaguggguccaauacuucuaucaggaggccgcccccgcucagucugacguggcccuccugcgguuugugaacccugauaccggaagaguucuuuucgaauguaagcugcacaaaagcggcuacgucacaguggcucauaccgggcagcacgaccucgugauucccccgaauggauauuuucgcuucgauuccugggucaaccaauucuacacgcuggccccuaugggcaacgggaccggccggagacgcguguga

SEQ ID NO: 29111 - RNA, 1620 nt, Artificial Sequence
  derived and/or modified sequence opt5 from VP1__Norovirus_and/or_Norovirus-like__KX354119
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccauccugacgguggaggaaaugaccaauucuagauuuccuauuccccuugagaagcuguucacagggccguccagcgccuucgucgugcagccucagaacggacgguguaccacagauggcguucuccuggggaccacgcaacugucucccgugaauaucugcacauuucgcggagacaucacccauauuacaggcucccacaacuacaccaugaaucucgcuagccagaacuggaacuccuaugauccuaccgaggaaauccccgcgccucugggcacacccgacuucgucgggaaaauucagggagugcuuacgcagaccacaagagccgacggcucuacccgggggcauaaggcuacagucuacaccggaagcgccgauuuugccccgaagcugggccgcgugcaauucgagacggacacaaaucacgauuuugaagcuaaucagaacaccaaauucaccccuguuggggugauccaggacggaggcacaacccacagaaaugagccccaacaguggguccuccccuccuacagcggccggaacacacauaaugugcaccuggccccugcgguugcuccgacguuucccggggaacagcuucuguucuuucgcucuaccaugccuggauguuccggcuaucccaacauggaucucgacugccugcugccucaggagugggugcaauucuuuuaccaggaggccgcccccgcucagagcgaugucgcccuccugagauucgugaauccugacacagggcgggugcuuuuugaauguaagcugcauaaacccggauauguuaccgucgcucacacaggccagcacgaucucgugauuccgccuaacggguacuucagauucgacucuugggugaaccaauuuuauacccuggcccccaugggcaauggaacgggccgccggagagucuga

SEQ ID NO: 29112 - RNA, 1620 nt, Artificial Sequence
  derived and/or modified sequence opt5 from VP1__Norovirus_and/or_Norovirus-like__KX354018
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaauucgagacagacaccgaucaugacuuuggggccaaucagaacaccaaauucacaccugugggagucauccaggauggcagcaccacacaccggaaugaaccccaacagugggugcuccccuccuacagcggccgcaacacgcacaauguucaucuggcuccugccguggcgccgaccuuucccggggagcagcuucuguucuuuagaucuacaaugccuggauguuccggcuaucccaacauggaccucgauugccugcugccucaggaauggguccaauacuucuaucaggaggcugcccccgcccagagcgacguggcucuccugcgguuugugaauccugauaccgggagaguucuuuucgaguguaagcugcacaaaucuggauacgucacaguggcccauaccggccagcacgaccucgugauucccccgaacggguauuuucgcuucgauagcugggucaaccaauucuacacgcuggcuccuaugggcaauggaaccggccggagacgcguguga

SEQ ID NO: 29113 - RNA, 1620 nt, Artificial Sequence
  derived and/or modified sequence opt5 from VP1__Norovirus_and/or_Norovirus-like__AB972499
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucaucguggacgugagacaacucgagccuguccugauuccccugccugauguucggaacaauuuuuaucacuacaaccagagcaaugacuccacaaucaagcucauugccaugcuguauacaccccuucgcgcuaacaacgccggcgaugacguguucaccgugagcugcagaguccugacccggcccucuccugauuuugacuucaucuuucucgugccgcccacaguugaaucccgcaccaaaccuuucagcgugcccguccugacgguggaggaaaugaccaauucuagauuuccuauuccccuugagaagcuguucacagggccguccagcgccuucguugugcagccucagaacggacgguguaccacagauggcguccuccuggggaccacgcaacugucucccgugaauaucugcacauuucgcggagacgucacccauauuacaggcuccagaaacuacaccaugaaucucgcuagccagaacuggaauaacuaugauccuaccgaggaaauccccgcgccucugggcacacccgacuucguggggaaaauccagggaaugcuuacgcagaccacacggaccgacggcuccacacgcgggcacaaggccaccguuuacacgggaucugcugauuuugccccgaagcugggcagagugcaauucgagacagacaccgaucaugacuuugaagccaaucagaacaccaaauucacaccugucggggugauucaggauggaagcaccacacaccggaaugagccccaacaguggguucuccccuccuacagcggccgcaacacgcacaaugugcaucuggcuccugccgucgcgccgaccuuucccggcgaacagcuucuguucuuuagaucuacaaugccuggguguuccggauaucccaacauggaccucgauugccugcugccucaggagugggugcaauacuucuaucaggaggcugcccccgcccagagcgacguggcucuccugcgguuuguuaauccugauaccggcagaguccuuuucgaauguaagcugcacaaaucuggguacgugacaguggcccauaccggacagcacgaccucgucauucccccgaacggcuauuuucgcuucgauagcugggugaaccaauucuacacgcuggcuccuauggggaauggcaccggacggagacgcguuuga

SEQ ID NO: 29114 - RNA, 1620 nt, Artificial Sequence
  derived and/or modified sequence opt5 from VP1__Norovirus_and/or_Norovirus-like__KF060142
augaagauggccagcuccgacgcuaaccccucugauggcagcgccgcgaaucuggugccugaggucaacaaugaaguuauggcucucgacccgguggugggggccgccaucgcugcccccgucgcuggacagcaaaacgugauugauccuuggaucagaaauaacuucguucaggcccccggcggggaguuuaccguguccccucggaaugcgcccggagaaauucuguggucugccccucuuggcccggaccugaaccccuaccucagccaccuggcucgcauguauaauggguacgccggaggcuucgagguccaggugauccuugcuggcaacgccuuuacagcggggaaaauuaucuucgccgcuguuccucccaauuuuccuacggaaggacugucccccucucaggugaccauguucccgcauaucauugucgaugugagacaacucgagccugugcugaucccccugccugacguccggaacaauuuuuaucacuacaaccagagcaaugauuccacaauuaagcucaucgccaugcuguauacaccccuucgcgcuaacaacgccggcgacgauguuuucaccgugagcugcagagugcugacccggcccucuccugacuuugauuucauuuuucucgucccgcccacaguggagucccgcaccaaaccuuucagcguucccgugcugacggucgaagagaugaccaauucuagauuuccuaucccccuugaaaagcuguucacagggccguccagcgccuucgugguucagccucagaacggacgguguaccacagacggcgugcuccuggggaccacgcaacugucucccgucaauauuugcacauuucgcggagaugugacccauaucacaggcuccagaaacuacaccaugaaucucgcuagccagaacuggaauaacuaugacccuaccgaggagauccccgcgccucugggcacacccgacuucgucgggaaaauucagggaaugcuuacgcagaccacacggaccgauggcuccacacgcgggcacaaggccaccguguacacgggaucugcugacuuugccccgaagcugggcagaguucaauucgaaacagauaccgaccaugauuuugaggccaaucagaacaccaaauucacaccugugggggucauccaggacggaagcaccacacaccggaaugaaccccaacagugggugcuccccuccuacagcggccgcaacacgcacaauguucaucuggcuccugccguggcgccgaccuuucccggcgagcagcuucuguucuuuagaucuacaaugccuggguguuccggauaucccaacauggaucucgacugccugcugccucaggaauggguccaauacuucuaucaggaggcugcccccgcccagagcgauguggcucuccugcgguuugugaauccugacaccggcagaguucuuuucgaguguaagcugcacaaaucuggguacgucacaguggcccauaccggacagcacgaucucgugauucccccgaacggcuauuuucgcuucgacagcugggucaaccaauucuacacgcuggcuccuauggggaauggcaccggacggagacgcguguga

SEQ ID NO: 29115 - RNA, 1620 nt, Artificial Sequence
  derived and/or modified sequence opt5 from VP1__Norovirus_and/or_Norovirus-like__KF060138
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccaacgccuucgugguucagccucagaauggacgguguaccacagauggcgugcuccuggggaccacgcaacugagccccgucaacauuugcacauuucgcggagacgugacccauaucacaggcucuagaaauuacaccaugaaccucgcuucccagaauuggaacaauuaugauccuaccgaggaaauccccgcgccucugggcacacccgacuucgucgggaaaauucagggaaugcuuacgcagaccacacggaccgacggcagcacacgcgggcacaaggccaccguguacacgggauccgcugauuuugccccgaagcugggcagaguucaauucgagacagacaccgaucaugacuuugaagccaaccagaauaccaaauucacaccugugggggucauccaggauggaucuaccacacaccggaacgagccccaacagugggugcuccccagcuacuccggccgcaauacgcacaacguucaucuggcuccugccguggcgccgaccuuucccggcgaacagcuucuguucuuuagaagcacaaugccuggguguucuggauaucccaauauggaccucgauugccugcugccucaggaguggguccaauacuucuaucaggaggcugcccccgcccaguccgacguggcucuccugcgguuugugaacccugauaccggcagaguucuuuucgaauguaagcugcacaaaagcggguacgucacaguggcccauaccggacagcacgaccucgugauucccccgaacggcuauuuucgcuucgauucuugggucaaucaauucuacacgcuggcuccuauggggaacggcaccggacggagacgcguguga

SEQ ID NO: 29116 - RNA, 1620 nt, Artificial Sequence
  derived and/or modified sequence opt5 from VP1__Norovirus_and/or_Norovirus-like__KP784697
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugacccucccaauuuuccuacggagggacugucccccucucaggugaccauguucccgcauaugaucgucgaugugagacaacucgagccugugcugaucccccugccugacguccggaacaauuuuuaucacuacaaccagagcaaugaucccacacucaagcugauugccaugcuuuauacaccccugcgcgcuaacaacgccggcgacgauguuuucaccguguccugcagagugcucacccggccuagcccggacuuugauuucaucuuucuggugcccccuacagucgaaucucgcaccaaacccuucuccguuccuauucuuacgguggaggaaaugaccaauagcagauuucccaucccgcuggagaagcuguucacagggccuucuuccgccuucgucgugcagccccagaacggacgguguaccacagacggcguucugcuggggaccacgcaacucagcccugugaauauuugcacauuucgcggagauaucacccauauuacaggcucuagaaacuacaccaugaaucuggcuucccagaacuggaauaacuaugaccccaccgaggaaaucccugcgccccuuggcacaccggacuucgucgggaaaauccagggaaugcugacgcagaccacacggaccgauggcagcacacgcgggcacaaggccaccguguacacgggauccgcugacuuugccccuaagcucggcagaguccaauucgagacagauaccgaccaugauuuugaagccaaucagaacaccaaauucacacccguggggguuauucaggacggaucuaccacacaccggaaugagccccaacagugggugcugccuagcuacuccggccgcaacacgcacaauguccaucuugcuccggccguggcgcccaccuuuccuggcgaacagcuccucuucuuuagaagcacaaugcccggguguucuggauauccuaacauggaucuggacugccugcucccccaggaguggguucaauacuucuaucaggaggcugccccugcccaguccgauguggcucugcuucgguuugucaaucccgacaccggcagagugcuguucgaauguaagcuccacaaaagcggguacgugacaguugcccauaccggacagcacgaucuggucaucccgccuaacggcuauuuucgcuucgacucuugggugaaccaauucuacacgcuugcucccauggggaauggcaccggacggagacgcguguga

SEQ ID NO: 29117 - RNA, 1620 nt, Artificial Sequence
  derived and/or modified sequence opt5 from VP1__Norovirus_and/or_Norovirus-like__KF060111
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauccaggauggaggcaccacacaccggaaugagccccaacagugggugcuccccagcuacuccggccgcaacacgcacaauguucaucuggcuccugccguggcgccgaccuuucccggggaacagcuucuguucuuuagaagcacaaugccuggauguucuggcuaucccaacauggaccucgauugccugcugccucaggaguggguccaauacuucuaucaggaggcugcccccgcccaguccgacguggcucuccugcgguuugugaauccugauaccgggagaguucuuuucgaauguaagcugcacaaaagcggauacgucacaguggcccauaccggccagcacgaccucgugauucccccgaacggguauuuucgcuucgauucuugggucaaccaauucuacacgcuggcuccuaugggcaauggaaccggccggagacgcguguga

SEQ ID NO: 29118 - RNA, 1620 nt, Artificial Sequence
  derived and/or modified sequence opt5 from VP1__Norovirus_and/or_Norovirus-like__KF060089
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuaucccccuugagaagcuguucacagggccguccagcgccuucgugguccagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauucccgcgccucugggcacacccgacuucguugggaaaauccagggaaugcuuacgcagaccacacggaccgacggcuccacacgcgggcacaaggccaccguguacacgggaucugcugauuuugccccgaagcugggcagaguccaauucgagacagacaccgaucaugacuuugaagccaaucagaacaccaaauucacaccuguggggguuauccaggauggaagcaccacacaccggaaugagccccaacagugggugcuccccuccuacagcggccgcaacacgcacaauguccaucuggcuccugccguggcgccgaccuuucccggcgaacagcuucuguucuuuagaucuacaaugccuggguguuccggauaucccaacauggaccucgauugccugcugccucaggagugggugcaauacuucuaucaggaggcugcccccgcccagagcgacguugcucuccugcgguuugucaauccugauaccggcagagugcuuuucgaauguaagcugcacaaaucuggguacgugacagucgcccauaccggacagcacgaccucgugauucccccgaacggcuauuuucgcuucgauagcuggguuaaccaauucuacacgcuggcuccuauggggaauggcaccggacggagacgcguguga

SEQ ID NO: 29119 - RNA, 1620 nt, Artificial Sequence
  derived and/or modified sequence opt5 from VP1__Norovirus_and/or_Norovirus-like__KP096333
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucauugugcagccccagaacggacgguguacaaccgauggcguucuccuggggacgacacaacugagcccugugaauaucugcaccuuucgcggagacgucacacauaucucuggcuccagaaacuacaccaugaaucucgccagccagaacuggaacuccuaugaucccaccgaggaaaccccugcuccccugggcacgccggacuucguggggaaaauucagggaguccuuacccagacaacccggacagacggcucuacccgcgggcacaaggcgacgguguacacaggaagcgccgauuuuuccccuaagcugggcagaguucaauucgcuaccgacaccgauaaugacuuugugacaaaucagaacaccaaauucacacccgucggggugauccaggauggaagcacgacaccccggaaugagccucaacaguggguucucccgucuuacuccggccgcaacacacauaaugugcaccuggcccccgccgucgcuccuaccuuucccggcgaacagcuucuguucuuuagaagcacaaugccuggguguucuggauaucccaacauggaccucgauugccugcugccucaggagugggugcaauacuucuaucaggaagccgcgcccgcucagagcgacguggcccuccugcgguuuguuaauccggauaccggcagaguccuuuucgaguguaagcugcacaaaacgggguacgugaccguggcccauacaggacagcacgaccucgucauuccucccaacggcuauuuucgcuucgauuccugggugaaccaauucuacacccuggcuccuauggggaauggcacaggacggagacgcguuuga

SEQ ID NO: 29120 - RNA, 1620 nt, Artificial Sequence
  derived and/or modified sequence opt5 from VP1__Norovirus_and/or_Norovirus-like__KF060153
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucgaggugauccuugcuggcaacgccuuuacagcggggaaaauuaucuucgccgcuguuccucccaauuuuccuacggagggacugucccccucucaggugaccauguucccgcauaucauugucgacgugagacagcucgaaccugugcugaucccccugccugauguccggaacaauuuuuaucacuacaaccaaagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggagucccgcaccaaaccuuucagcguucccgugcugacggucgaagagaugaccaauucuagauuuccuaucccccuugagaagcuguucacagggccguccagcgccuucgugguucagccucagaacggacgguguaccacagauggcgugcuccuggggaccacgcagcugucucccgucaauauuugcacauuucgcggagacgugacccauaucacaggcuccagaaacuacaccaugaaucucgcuagccaaaacuggaauaacuaugauccuaccgaagagauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaguucgaaacagacaccgaucaugacuuugaggccaaucaaaacaccaaauucacaccugugggggucauccaggauggaagcaccacacaccggaaugaaccccagcaaugggugcuccccuccuacagcggccgcaacacgcacaauguucaucuggcuccugccguggcgccgaccuuucccggcgagcagcuucuguucuuuagaucuacaaugccuggguguuccggauaucccaacauggaccucgauugccugcugccucaggaguggguccaguacuucuaucaagaagcugcccccgcccagagcgacguggcucuccugcgguuugugaauccugauaccggcagaguucuuuucgaguguaagcugcacaaaucuggguacgucacaguggcccauaccggacagcacgaccucgugauucccccgaacggcuauuuucgcuucgauagcugggucaaccaguucuacacgcuggcuccuauggggaauggcaccggacggagacgcguguga

SEQ ID NO: 29121 - RNA, 1620 nt, Artificial Sequence
  derived and/or modified sequence opt5 from VP1__Norovirus_and/or_Norovirus-like__KF060125
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucgaggugauccuugcuggcaacgccuuuacagcggggaaaauuaucuucgccgcuguuccucccaauuuuccuacggagggacugucccccucucaggugaccauguucccgcauaucauugucgacgugagacagcucgaaccugugcugaucccccugccugauguccggaacaauuuuuaucacuacaaccaaagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggagucccgcaccaaaccuuucagcguucccgugcugacggucgaagagaugaccaauucuagauuuccuaucccccuugagaagcuguucacagggccguccagcgccuucgugguucagccucagaacggacgguguaccacagauggcgugcuccuggggaccacgcagcugucucccgucaauauuugcacauuucgcggagacgugacccauaucacaggcuccagaaacuacaccaugaaucucgcuagccaaaacuggaauaacuaugauccuaccgaagagauccccgcgccucugggcacacccgacuucgucgggaaaauucagggaacgcuuacccagacaacccggacagacggcuccacccgcgggcacaaggccacgguguacacaggaucugcugauuuugccccgaagcugggcagaguucaguucgaaaccgacaccgaucaugacuuugaggccaaucaaaacacaaaauucaccccugugggggucauccaggauggaagcacaacgcaccggaaugaaccccagcaaugggugcuccccuccuacagcggccgcaacacccacaauguucaucuggcuccugccguggcgccgacauuucccggcgagcagcuucuguucuuuagaucuaccaugccuggguguuccggauaucccaacauggaccucgauugccugcugccucaggaguggguccaguacuucuaucaagaagcugcccccgcccagagcgacguggcucuccugcgguuugugaauccugauacaggcagaguucuuuucgaguguaagcugcacaaaucuggguacgucaccguggcccauacgggacagcacgaccucgugauucccccgaacggcuauuuucgcuucgauagcugggucaaccaguucuacacccuggcuccuauggggaauggcacaggacggagacgcguguga

SEQ ID NO: 29122 - RNA, 1620 nt, Artificial Sequence
  derived and/or modified sequence opt5 from VP1__Norovirus_and/or_Norovirus-like__KX354135
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccauccugacgguggaggaaaugaccaauucuagauuuccuauuccccuugagaagcuguucacagggccguccagcgccuucgucgugcagccucagaacggacgguguaccacagauggcguucuccuggggaccacgcaacugucucccgugaauaucugcacauuucgcggagacaucacccauauuacaggcucccacaacuacaccaugaaucucgcuagccagaacuggaacuccuaugauccuaccgaggaaauccccgcgccucugggcacacccgacuucgucgggaaaauucagggagugcuuacgcagaccacaagagccgacggcucuacccgggggcauaaggcuacagucuacaccggaagcgccgauuuugccccgaagcugggccgcgugcaauucgagacggacacaaaucacgauuuugaagcuaaucagaacaccaaauucaccccuguuggggugauccaggacggaggcacaacccacagaaaugagccccaacaguggguccuccccuccuacagcggccggaacacacauaaugugcaccuggccccugcgguugcuccgacguuucccggggaacagcuucuguuccucaagucuaccaugccuggauguuccggcuaucccaacauggaucuggacugccugcucccucaggagugggugcaauuuuucuaccaggaggccgcccccgcucagagcgaugucgcccugcuucgcuuugugaauccugacacagggagagugcuguucgaauguaaacuccauaagucuggauauguuaccgucgcucacacaggccagcacgaucuggugauucccccgaacggguacuuucgguucgacagcugggugaaccaauucuauacccuugccccuaugggcaauggaacgggcagacgccgggucuga

SEQ ID NO: 29123 - RNA, 1620 nt, Artificial Sequence
  derived and/or modified sequence opt5 from VP1__Norovirus_and/or_Norovirus-like__KX354045
augaagauggccagcuccgacgcuaaccccucugauggcagcgccgcgaaucuggugccugacgucaacaaugagguuauggcucucgaaccgguggugggggccgccaucgcugcccccgucgcuggacagcaaaacgugaucgauccuuggaucagaaauaacuucguucaggcccccggcggggaguuuaccguguccccucggaaugcgcccggagaaauucuguggucugccccucuuggcccggaccugaaccccuaccucagccaccuggcucgcauguauaauggguacgccggaggcuucgagguccaggugguucuugcuggcaacgccuuuacagcggggaaaaucauuuucgccgcugugccucccaauuuuccuacggaaggacugucccccucucaggucaccauguucccgcauaucaucguggaugugagacaacucgagccuguccugauuccccugccugacguucggaacaauuuuuaucacuacaaccagagcaaugauuccacaaucaagcucauugccaugcuguauacaccccuucgcgcuaacaacgccggcgacgauguguucaccgugagcugcagaguccugacccggcccucuccugacuuugauuucaucuuucucgugccgcccacaguugagucccgcaccaaaccuuucagcgugcccguccugacgguggaagagaugaccaauucuagauuuccuauuccccuugaaaagcuguucacagggccguccagcgccuucguugugcagccucagaacggacgguguaccacagacggcguccuccuggggaccacgcaacugucucccgugaauaucugcacauuucgcggagaugucacccauauuacaggcuccagaaacuacaccaugaaucucgcuagccagaacuggaauaacuaugacccuaccgaggagauccccgcgccucugggcacacccgacuucguggggaaaauccagggaaugcuuacgcagaccacacggaccgauggcuccacacgcgggcacaaggccaccguuuacacgggaucugcugacuuugccccgaagcugggcagagugcaauucgaaacagauaccgaccaugauuuugaggccaaucagaacaccaaauucacaccugucggggugauucaggacggaagcaccacacaccggaaugaaccccaacaguggguucuccccuccuacagcggccgcaacacgcacaaugugcaucuggcuccugccgucgcgccgaccuuucccggcgagcagcuucuguucuuuagaucuacaaugccuggguguuccggauaucccaacauggaucucgacugccugcugccucaggaaugggugcaauacuucuaucaggaggcugcccccgcccagagcgauguggcucuccugcgguuuguuaauccugacaccggcagaguccuuuucgaguguaagcugcacaaaucuggguacgugacaguggcccauaccggacagcacgaucucgucauucccccgaacggcuauuuucgcuucgacagcugggugaaccaauucuacacgcuggcuccuauggggaauggcaccggacggagacgcguuuga

SEQ ID NO: 29124 - RNA, 1620 nt, Artificial Sequence
  derived and/or modified sequence opt5 from VP1__Norovirus_and/or_Norovirus-like__LC153121
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugauccauaucaccggcuccagaaacuacacaaugaaucucgcuagccagaacuggaauaacuaugauccuaccgaggaaauucccgcgccucugggcacccccgacuucgucgggaaaauccagggaaugcuuacacagacgacccggacagacggcuccacccgcgggcacaaggccacaguguacaccggaucugcugauuuugccccgaagcugggcagaguucaauucgagacggacacagaucaugacuuugaagccaaucagaacaccaaauucaccccugugggggucauucaggauggaagcacaacccaccggaaugagccccaacagugggugcuccccuccuacagcggccgcaacacacacaauguucaucuggcuccugccguggcgccgacguuucccggcgaacagcuucuguucuuuagaucuaccaugccuggguguuccggauaucccaacauggaccucgauugccugcugccucaggaguggguccaauacuucuaucaggaggcugcccccgcccagagcgacguggcucuccugcgguuugugaauccugauacaggcagaguucuuuucgaauguaagcugcacaaaucuggguacgucaccguggcccauacaggacagcacgaccucgugauucccccgaacggcuauuuucgcuucgauagcugggucaaccaauucuacacccuggcuccuauggggaauggcacgggacggagacgcguguga

SEQ ID NO: 29125 - RNA, 1620 nt, Artificial Sequence
  derived and/or modified sequence opt5 from VP1__Norovirus_and/or_Norovirus-like__KF668568
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcuaucccucccaauuuuccuacggagggacugucccccucucaggugaccauguucccgcauaucgucguggacgugagacaacucgagccuguccugauuccccugccugauguucggaacaauuuuuaucacuacaaccagagcaaugaccccacaaucaagcucauugccaugcuguauacaccccuucgcgcuaacaacgccggcggggauguguucaccguguccugcagaguccugacccggccuagcccggacuuugauuucaucuuucucgugcccccuacaguugaaucucgcaccaaacccuucuccgugccuguccugacgguggaggaaaugaccaauagcagauuucccauuccgcuugagaagcuguucacaggaccuucuuccgccuucguugugcagccccagaacggccgguguaccacagacgggguccuccugggaaccacgcaacugagcccugugaauaucugcacauuucgcggcgaugucacccauauuacaggcucuagaaacuacaccaugaaucucgcuucccagaacuggaauaacuaugaccccaccgaggaaaucccugcgccccuggggacaccggauuucgugggaaaaauccagggcaugcuuacgcagaccacacggaccgacgggagcacacgcggacacaaggccaccguuuacacgggcuccgcugacuuugccccuaagcuggggagagugcaauucgagacagauaccgaccaugauuuugaagccaaucagauuaccaaauucacacccaucggagucauucaggacggcucuaccacacaccggaacgagccccaacagugggugcucccuagcuacuccggccgcaauacgcacaacguucaucuggcuccggccguggcgcccaccuuuccuggggaacagcuucuguucuuuagaagcacaaugcccggauguucuggcuauccuaauauggaucucgacugccugcugccccaggaguggguccaauacuucuaucaggaggcugccccugcccaguccgauguggcucuccugcgguuugugaaccccgacaccgggagaguucuuuucgaauguaagcugcacaaaagcggauacgucacaguggcccauaccggccagcacgaucucgugaucccgccuaauggguauuuucgcuucgacucuugggucaaccaauucuacacgcuggcucccaugggcaacggaaccggccggagacgcguguga

SEQ ID NO: 29126 - RNA, 1620 nt, Artificial Sequence
  derived and/or modified sequence opt5 from VP1__Norovirus_and/or_Norovirus-like__KF668567
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguccaccgucagcugcagagugcugacccggccuucuccggauuucgacuuuauuuuccucguucccccuacaguggaaucccgcaccaaacccuuuagcgucccugugcugacgguugaggaaaugaccaauucuagauuccccaucccgcuugagaagcuguuuacagggccuuccagcgccuucgugguccagccccagaacggacgguguaccacagauggcgugcuccuggggaccacgcaacugucuccugucaauauuugcacauuccgcggagacgugacccauaucacaggcuccagaaacuacaccaugaaucucgcuagccagaacuggaauaacuaugaucccaccgaggaaauuccugcgccccugggcacaccggacuuuguugggaaaauccagggaaugcuuacgcagaccacacggaccgacggcuccacacgcgggcacaaggccaccguguacacgggaucugcugauuucgccccuaagcugggcagaguccaauuugagacagacaccgaucaugacuucgaagccaaucagaacaccaaauuuacacccaucggggugauucaggauggaagcaccacacaccggaaugagccccaacaguggguucucccuuccuacagcggccgcaacacgcacaaugugcaucuggcuccggccgucgcgcccaccuucccuggcgaacagcuucuguuuuucagaucuacaaugcccggguguuccggauauccuaacauggaccucgauugccugcugccccaggagugggugcaauacuuuuaucaggaggcugccccugcccagagcgacguggcucuccugcgguucguuaaucccgauaccggcagaguccuuuuugaauguaagcugcacaaaucuggguacgugacaguggcccauaccggacagcacgaccucgucaucccgccuaacggcuauuuccgcuuugauagcugggugaaccaauucuacacgcuggcucccauggggaauggcaccggacggagacgcguuuga

SEQ ID NO: 29127 - RNA, 1620 nt, Artificial Sequence
  derived and/or modified sequence opt5 from VP1__Norovirus_and/or_Norovirus-like__KR904210
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucgccggcuccagaaacuacaccaugaaucucgcuagccagaacuggaacuccuaugauccuaccgaggaaauucccgcgccucuggagacacccgacuucgugggcaaaauccaggggguccuuacgcagaccacacggaccgacggaucuacacgcggccacaaggccaccguguacacggggagcgcugauuuuuccccgaagcugggaagaguucaauucgccacagacaccgauaaugacuuugauagcaaucagaacaccaaauucacaccugugggcgucauucaggacgggggaaccacacaucggaaugaaccccaacagugggugcuccccucuuacuccggccgcgauauccacaacguucaccuggccccugcuguggccccgacguuucccggcgagcagcuucuguucuuuagaagcaccaugccuggguguucuggauaucccaauauggaccucgauugccugcugccucaggaauggguccaauacuucuaucaggaggcggcucccgcccagagcgacguggcccuccugcgguuugugaacccugauacaggcagaguucuuuucgaguguaagcugcauaaauccggguacgucaccguggcucacacaggacagcaugaccucgugauucccccgaauggcuauuuucgcuucgacucuugggucaaccaauucuacacccuggccccuauggggaacggcacgggacggagacgcguguga

SEQ ID NO: 29128 - RNA, 1620 nt, Artificial Sequence
  derived and/or modified sequence opt5 from VP1__Norovirus_and/or_Norovirus-like__JX459907
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuaucccccuugagaagcuguucacagggccguccagcgccuucgugguccagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgacgagauucccgcgccucugggcacacccgacuucguugggaaaauccagggaaugcuuacgcagaccacacggaccgauggcuccacacgcgggcacaaggccaccguguacacgggaucugcugacuuugccccgaagcugggcagaguccaauucgaaacagauaccgaccaugauuuugaggccaaucagaacaccaaauucacaccuguggggguuauccaggacggaagcaccacacaccggaaugaaccccaacagugggugcuccccuccuacagcggccgcaacacgcacaauguccaucuggcuccugccguggcgccgaccuuucccggcgagcagcuucuguucuuuagaucuacaaugccuggguguuccggauaucccaacauggaucucgacugccugcugccucaggaaugggugcaauacuucuaucaggaggcugcccccgcccagagcgauguugcucuccugcgguuugucaauccugacaccggcagagugcuuuucgaguguaagcugcacaaaucuggguacgugacagucgcccauaccggacagcacgaucucgugauucccccgaacggcuauuuucgcuucgacagcuggguuaaccaauucuacacgcuggcuccuauggggaauggcaccggacggagacgcguguga

SEQ ID NO: 29129 - RNA, 1620 nt, Artificial Sequence
  derived and/or modified sequence opt5 from VP1__Norovirus_and/or_Norovirus-like__KF060062
augaagauggccagcuccgacgcuaaccccaccgauggcucugccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaacgccggcgaugacguuuucaccguguccugcagagugcugacacggcccagcccugauuuugacuucauuuuucucgucccgcccaccguggaaucucgcacgaaaccuuucuccguucccgugcugaccgucgaggaaaugacaaauagcagauuuccuaucccccuugagaagcuguucaccgggccgucuuccgccuucgugguucagccucagaacggacgguguacaaccgauggcgugcuccuggggacgacacaacugagccccgucaauauuugcaccuuucgcggagacgugacacauaucaccggcucuagaaacuacaccaugaaucucgcuucccagaacuggaauaacuaugauccuacagaggaaacgcccgcgccucugggcacccccgacuucgucgggaaaauccagggaaugcuuacacagaccacacggaccgacggcagcacgcgcgggcacaaggccacaguguacaccggauccgcugauuuugccccgaagcugggcagaguucaauucgagaccgacacagaucaugacuuugaagccaaucagaacaccaaauucacaccugugggggucauucaggauggaucuacgacccaccggaaugagccccaacagugggugcuccccagcuacuccggccgcaacacacacaauguucaucuggcuccugccguggcgccgaccuuucccggcgaacagcuucuguucuuuagaagcacaaugccuggguguucuggauaucccaacauggaccucgauugccugcugccucaggaguggguccaauacuucuaucaggaggcugcccccgcccaguccgacguggcucuccugcgguuugugaauccugauaccggcagaguucuuuucgaauguaagcugcacaaaagcggguacgucacgguggcccauaccggacagcacgaccucgugauucccccgaacggcuauuuucgcuucgauucuugggucaaccaauucuacacacuggcuccuauggggaauggcaccggacggagacgcguguga

SEQ ID NO: 29130 - RNA, 1620 nt, Artificial Sequence
  derived and/or modified sequence opt5 from VP1__Norovirus_and/or_Norovirus-like__KF060080
augaagauggccagcuccgacgcuaaccccucugauggcagcgccgcgaaucuggugccugaggucaacaaugaaguuauggcucucgagccgguggccggggccgcuaucgccgcucccguggccggacagcaaaacgucauugacccuuggaucagaaauaacuucgugcaggcgcccggcggggaauuuaccguuuccccucggaaugcccccggagagauucuguggucugcuccucuuggcccggaucugaaccccuaccucagccaccuggcccgcauguauaauggguacgcuggaggcuucgaagugcaggucauccuugccggcaacgcguuuacagccgggaaagugauuuucgcugccguuccucccaauuuuccuacggagggacugucccccucucaggugaccauguucccgcauaucgucguggacgugagacaacucgagccuguccugaucccccugccugauguucggaacaauuuuuaucacuacaaccagagcaaugacuccacaauuaagcucaucgcuaugcuguauacaccccuucgcgccaacaacgccggcgaugacguguucaccgugagcugcagaguccugacccggcccucuccugauuuugacuucauuuuucucgugccgcccacaguugaaucccgcaccaaaccuuucagcgugcccguccugacgguggaggaaaugaccaauucuagauuuccuaucccccuugagaagcuguucacagggccguccagcgcuuucguugugcagccucagaacggacgguguaccacagauggcguccuccuggggaccacgcaacugucucccgugaauauuugcacauuucgcggagacgucacccauaucacaggcuccagaaacuacaccaugaaucucgcgagccagaacuggaauaacuaugauccuaccgaggaaauucccgccccucugggcacacccgacuucguggggaaaauccagggaaugcuuacgcagaccacacggaccgacggcuccacacgcgggcacaaggcuaccguuuacacgggaucugccgauuuugccccgaagcugggcagagugcaauucgagacagacaccgaucaugacuuugaagcuaaucagaacaccaaauucacaccugucggggugauccaggauggaagcaccacacaccggaaugagccccaacaguggguucuccccuccuacagcggccgcaacacgcacaaugugcaucuggccccugcggucgcuccgaccuuucccggcgaacagcuucuguucuuuagaucuacaaugccuggguguuccggauaucccaacauggaccucgauugccugcugccucaggagugggugcaauacuucuaucaggaggccgcccccgcucagagcgacguggcccuccugcgguuuguuaauccugauaccggcagaguccuuuucgaauguaagcugcacaaaucuggguacgugacaguggcucauaccggacagcacgaccucgucauucccccgaacggcuauuuucgcuucgauagcugggugaaccaauucuacacgcuggccccuauggggaauggcaccggacggagacgcguuuga

SEQ ID NO: 29131 - RNA, 1620 nt, Artificial Sequence
  derived and/or modified sequence opt5 from VP1__Norovirus_and/or_Norovirus-like__KF378731
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuugcggccgggaaaauuaucuucgcugccguuccucccaauuuuccuacagagggacugucccccucucaggugacgauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgccggcgaugacguuuucaccgugagcugcagagugcugacacggcccucuccugauuuugacuucauuuuucucgucccgcccaccguggaaucccgcacaaaaccuuucagcguucccgugcugaccgucgaggaaaugaccaauucuagauuuccuaucccccuugagaagcuguucacggggccguccagcgcuuucgugguucagccucagaacggacgguguacaaccgauggcgugcuccuggggacaacccaacugucucccgucaauauuugcacgcuccgcggagacgugacacauaucaccggcuccagaaacuacacaaugaaucuggcgagccagaacuggaauaacuaugauccuaccgaggaaauccccgccccucuuggcacccccgacuuugucgggaaaauucagggaaugcugacacagacgacccggacagacggcuccacccgcggguacaaggcuacaguguacaccggaucugccgauuucgccccgaagcucggcagaguucaauuugagacggacacagaucacgacuucgaagcuaaucagaacaccaaauuuaccccugugggggucauccaggauggaagcacaacccaucggaaugagccccaacagugggugcugcccuccuauagcggccgcaacacacacaauguucaccuugccccugcgguggcuccgacguuccccggcgaacagcugcucuuuuucagaucuaccaugccuggguguuccggauaccccaacauggaccuggauugccugcucccucaggaguggguccaauauuuuuaccaggaggccgcccccgcucagagcgacguggcccugcuucgguucgugaauccugauacaggcagaguucuguuugaauguaagcuccauaaaucuggguaugucaccguggcucacacaggacagcaugaccuggugauucccccgaacggcuacuuccgcuuugauagcugggucaaccaauucuauacccuugccccuauggggaauggcacgggacggagacgcguguga

SEQ ID NO: 29132 - RNA, 1620 nt, Artificial Sequence
  derived and/or modified sequence opt5 from VP1__Norovirus_and/or_Norovirus-like__AB933731
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcaaggugucucccaucccgcuuaaaaagcuguuuaccgggccuuccagcgccuucguugugcagccccagaacggaagauguacaaccgauggcguccuccuggggacgacacaacugucuccugugaauauuugcaccuuccggggagacgucacacauauccccggcucccgcaacuacaccaugaaucucgccagccagaacuggaacuccuaugauccuaccgaggagauccccgcuccgcugggcacaccugacuuuguggggaagauucagggaguucuuacgcagaccacaagaaccaauggcucuacacgggggcacaaagcgaccguguacacgggaagcgccgacuucucccccaagcugggccgcguccaauuugcuacagauaccgacaaugauuucgaaaccaaccagaauacaaaauuuacccccguggggguuauccaggacggaagcacaacgccuagaaacgagccgcaacagugggugcuccccucuuacuccggccggaauauucauaacguccaccuggccccugccguggcucccaccuucccuggcgaacagcuucuguuuuuccgcagcacaaugcccggguguucuggauauccuaauauggaucucgacugccugcugccccaggagugggugcaauacuuuuaucaggaagccgcgccggcucagagcgauguugcccuccugagauucgucaacccugacaccggccgggugcuuuuugaguguaagcugcacaaauccggguacgugacagucgcccauaccggacagcacgaucucgugauucccccuaacggcuauuucagauuugacucuuggguuaaucaauucuacacgcuggcucccauggggaacggcaccggacgccggagauga

SEQ ID NO: 29133 - RNA, 1620 nt, Artificial Sequence
  derived and/or modified sequence opt5 from VP1__Norovirus_and/or_Norovirus-like__AB933749
augaagauggccagcaacgacgugaaucccuccgauggcucuaccgcuaaccuggucccugagguuaauaacgaagugauggcccucgagccgguggucggggcggcuaucgccgcccccguggcuggacagcaaaauguuauugacccuuggaucagaaacaauuucgugcaggcccccggcggggaauuuacagucagcccucggaacgcucccggagagauucugugguccgccccucuuggcccggaucugaaucccuaccucucucaccuggcgcgcauguauaacggguacgccggaggcuucgaagugcagguuauccuugcuggcaaugccuuuacggcuguggucagaauuaucuucagcgccgugccucccaacuuuccuaccgaggggcugucccccucucaggugacaauguucccgcauaucauugucgacguucggcaacucgagccugugcugaucccccugccugaugugcgcaauaacuuuuaucacuacaaucagagcaacgacuccaccauuaaacucaucgcgaugcuguauacaccccuuagagccaacaaugcuggagaugacgucuucaccgugagcugccggguucugacacgccccucuccugauuuugacuucauuuuucucgugccgcccaccgucgaauccagaacgaagccuuucagcgugcccguucugaccguggaggaaaugacaaacucucgguuuccuaucccccuugagaaacuguucaccggcccguccagcgccuucgucgugcagccucagaaugggcgcuguacaaccgauggaguccuccugggcacgacacaacugucucccgugaacauuugcaccuuuagaggggacguuacacauaucuccggaagccggaauuacaccaugaaccucgcuucccagaauuggaacucuuaugauccuaccgaggaaauccccgccccucugggcacacccgacuucgugggcaagauucaggggguccuuacgcagaccacacgcaccaauggaagcacaagaggccacaaagccaccguguacacgggguccgcugacuuuagcccgaagcugggacggguucaauucgcgacagauaccgacaacgauuuugagaccaaucagaacacaaaguucaccccugugggcgucauccaggacgggucuacaacgccccgcaaugaaccccaacagugggugcucccuuccuacagcggaagaaacauucauaaugugcaccuggccccggcuguugcccccaccuuuccuggcgagcagcuucuguucuuucggucuacaaugcccggcuguagcggguauccuaacauggaucucgacugccugcugccccaggaauggguccaauacuucuaucaggaggccgcuccugcccaguccgauguggcgcuccugagauuugugaaccccgacaccggacgcguccuuuucgaguguaaacugcacaagucuggcuacgugacaguugcucauaccgggcagcacgaucucgugaucccgccuaauggauauuuucgguucgacagcugggucaaccaauucuacacgcuggcccccaugggcaaugggaccggcagacgccgguga

SEQ ID NO: 29134 - RNA, 1620 nt, Artificial Sequence
  derived and/or modified sequence opt5 from VP1__Norovirus_and/or_Norovirus-like__KC517370
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccuuccaauuuucccacggagggacugucuccuagccaggucaccauguucccccauaucaucguggacgugagacaacucgagccgguccugauuccucugcccgauguucggaacaauuuuuaucacuacaaccaguccaaugacagcacaaucaagcucauugccaugcuguauacccuucugcgcgcuaacaacgccggcgaugacguguucacagugucuugcagaguccucacccggccuucccccgauuuugacuucaucuuucuggugcccccuacaguugaaagccgcaccaaaccguucucugugcccguccuuacgguggaggaaaugaccaauuccagauuuccuauuccccuggagaagcuguucacagggccuagcucugccuucguugugcagccccagaacggacgguguaccacagauggcguccugcuggggaccacgcaacucuccccggugaauaucugcacauuucgcggagacgucacccauauuacaggcagcagaaacuacaccaugaaucuggcuucccagaacuggaauaacuaugauccuaccgaggaaauccccgcgccucuuggcacacccgacuucguggggaaaauccagggaaugcugacgcagaccacacggaccgacggcucuacacgcgggcacaaggccaccauguacacgggaagcgcugauuuugccccuaagcucggcagaguucaauucgagacagacaccgaucaugacuuugaagccaaucagaacaccaaauucacacccgugggggucauucaggauggaggcaccacacaccggaaugagccgcaacagugggugcugccuuccuacagcggccgcaacacgcacaauguucaucuugcucccgccguggcgcccaccuuuccuggggaacagcuccucuucuuuagaccgacaaugcccggauguucuggcuauccuaacauggaccuggaucggcugcucccccaggaguggguccaauacuucuaucaggaggcugccccugcccaguccgacguggcucugcuuagauuugugaaucccgauaccgggcgcguucuguucgaaugcaagcuccacaaaagcggauacgucacaguggcccauaccggccagcacgaccuggugaucccucccaacggguauuuucgguucgauucuugggucaaccaauucuacacgcuugcuccgaugggcaauggaaccggcagacgccggguguga

SEQ ID NO: 29135 - RNA, 1620 nt, Artificial Sequence
  derived and/or modified sequence opt5 from VP1__Norovirus_and/or_Norovirus-like__EF547396
augaugauggccagcaaggacgcucccaccaacauggauggcacauccggggccggacagcuggugccugaggcgaauacggcugaaccgaucucuauggaccccgucgccggcgccgcuaccgccguugcuacagccgggcaaauuaacaugaucgauccuuggauuaugagcaauuucgugcaggcgccccagggagaguuuaccguguccccuaacaauacacccggcgacguccucuucgaucugcagcuugggccucaacugaacccguuucucgcccaccuggcucagauguacaauggaugggugggcaacaugagaguuaaagugcuucuggccggcaaugcuuucaccgccgggaagaucauuaucucuugcauucccccuggauuuacaagccagaacaucuccaucgcgcagaugaccauguucccccaugucauugccgacgugcggguucucgaaccuaucgaggugccccuggaagauguccgcaaugugcuguuucacacgaacgacaauagaccgaccaugcggcucguguguaugcuguauacaccucuucgcgcuaacggcucuagcuccgggaccgaucccuucgucauugccggaagaguucugacaugcccugacagcaauuuuucuuuccucuuucuggugccucccaacguggagcagaaaacccggcccuucuccgucccgaacaucccccuuaauacgcugagcaacucucgcgugccuucccucauuaagagcaugacaaucucuagagaucaaaaucagaucauucaguuucaaaacggccggguuacccuggacgggcagcugcagggaacaacccccaccuccgugagccaacucuguaaaauccgcggcacaacguaccaugcuaccggcgggaauggaauuaaccugacagagcuuaauggcgaaccuuaucacgccuucgagucccccgccccgaucggguucccugaucugggaggcugcgacuggcaucucaccgcuacacccacccaggcguuuaacgacggggccaaggucgugagacugucuguuacgcagggagcugccuucgccccucaccuuggcacaauucacuacaccaccacagauaccgacuauagccccaauacauccaucaucuguacgcuggauuggcucagccagaccacaggccaaucuaacguggacccuuggcagauucccaccuacggguccacacugaccgaagcugcccagcuggcgccgccuaucuuuccucccggauucggcgagacgcucgucuuuuuccugagcgauuuucccauuucuaaugggaagaacggacuuagcgugccgugcacccugccccaggaguucgucacacauuuugugaaugaacaagcuccuauccggggcgaggccgcccuccugcacuauguugaccccgauacccaucgcaaccuuggggaguucaaacuguacccugaaggcuuuaugacaugugugcccaauaccuccggaggcgggccucagacgcuccccauuaacggagucuucguguuuguuucuugggugagcagauucuaccagcugaagccggucggcacagcuggggccgcucggcgccuguga

SEQ ID NO: 29136 - RNA, 1620 nt, Artificial Sequence
  derived and/or modified sequence opt5 from VP1__Norovirus_and/or_Norovirus-like__JN699047
augaugauggccagcaaggacgcucccaccaacauggauggcacauccggggccggacagcuggugccugaggcgaauacggcugaaccgaucucuauggaccccgucgccggcgccgcuaccgccguugcuacagccgggcaaauuaacaugaucgauccuuggauuaugagcaauuucgugcaggcgccccagggagaguuuaccguguccccuaacaauacacccggcgacguccucuucgaucugcagcuugggccucaacugaacccguuucucgcccaccuggcucagauguacaauggaugggugggcaacaugagaguuaaagugcuucuggccggcaaugcuuucaccgccgggaagaucauuaucucuugcauucccccuggauuuacaagccagaacaucuccaucgcgcagaugaccauguucccccaugucauugccgacgugcggguucucgaaccuaucgagauuccccuggaagaugugcgcaauguccuguuucacacgaacgacaauagaccgaccaugcggcucguguguaugcuguauacaccucuucgcgcuaacggcucuagcuccgggaccgaucccuucgugaucgccggaagaguccugacaugcccugacagcaauuuuucuuuccucuuucugguuccucccaacguggagcagaaaacccggcccuucuccgugccgaacauuccccuuaauacgcugagcaacucucgcgucccuucccucaucaagagcaugacaaucucuagagaucaaaaucagauuauccaguuucaaaacggccgggugacccuggacgggcagcugcagggaacaacccccaccuccguuagccaacucuguaaaauucgcggcacaacguaccaugcuaccggcgggaauggaaucaaccugacagagcuuaauggcgaaccuuaucacgccuucgagucccccgccccgauuggguucccugaucugggaggcugcgacuggcaucucaccgcuacacccacccaggcguuuaacgacggggccaagguggucagacugucugugacgcagggagcugccuucgccccucaccuuggcacaauccacuacaccaccacagaucaugacuaugaucccaauaccagcaucauuuguacacuggacuggcucucccagacgaccggccaaaacaauguugauccuuggcagauccccacauacgggagcacccugacagaagcugcccagcuggcgccgccuauuuuuccucccggauucggcgagacccucguguuuuuccugucugacuuucccaucuccaacgggaagaauggacuuagcgucccgugcacgcugccccaggaguucgugacccacuuugucaacgaacaagcuccuauucggggcgaggccgcccuccugcauuauguggaucccgacacacaccgcaaucuuggggaguucaaacuguacccugaaggcuuuaugaccuguguucccaacacaucuggaggcgggccucagacccuccccaucaacggaguguucgucuuugugagcuggguuuccagauucuaccagcugaagccggugggcacggcuggggccgcucggcgccuguga

SEQ ID NO: 29137 - RNA, 1620 nt, Artificial Sequence
  derived and/or modified sequence opt5 from VP1__Norovirus_and/or_Norovirus-like__KT781411
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgauauccucuuugaccugcagcuugggccucaccugaauccguuccucucccaucuggcccaaauguauaacggaugggugggcaauaugaaagucaaggugcuucuggccggcaacgcuuuuaccgccgggaaaauuaucaucucuugcauucccccuggauucgcgagccagaauaucuccauugcccaggcuacaauguuuccccacguuaucgccgaugugagaguccucgaaccuauugaagugccccuggaggacguucggaacgugcuguuccauaauaacgauaauucuccgaccaugcgccucgucuguaugcuguacacgccucuuagagcuagcggcuccagcucugggaccgaccccuuugugaucgccggacgggugcugacaugcccuucccccgauuucagcuuucucuuccugguucccccuaacgucgagcagaagaccaaaccguuuucugugcccaaccuuccucugaauacacucuccaacagccgcgugcccucucugauuaaugccaugaugaucuccagagaccacggccaaaugguccaguuccagaacgggcgggugacccuggauggacagcuccaaggcacgacaccuaccagccugucccagcuuuguaagauccgcggcaagguuuuucuggcuucugggggaaauggccucaaccugacagaacuugacgggagcgcguaucaugccuucgagucccccgcuccgauuggauucccugauaucggcgacugcgacuggcacaugaaugccaccgccaccagcaacuuuacagggucuaaugaugaacaccagauucuggugaaacaagaguccacguucgcuccccaucucggacacguccaggccgaccaucugccugagguggcgaacaccgaucugaugguuagccucucuuggaucagccccguguccgaccagcacagacgggaugucgacccuugggugauuccccgcuacggcucuacacugaccgaagcugcccagcuugccccgccuaucuauccucccggcuuuggggaggcuaucgucuucuuuaugagcgauuuccccgugguuuccggagugaauggcaugcggauuccguguacacugccccaagaauacgucgcccacuuugugaacgagcaggcuccuaccagaggggaagccgcgcuccugcauuauguugaccccgauacgcaccgcaaucuuggagaguucaagaucuacccugagggcuuuaugacaugcgugcccaacagcucugggaccggcccucagacccugcccauuaauggagucuucacauuuguguccugggugagcagauucuaccagcucaaaccgguuggcaccgccgggccugcucggcgccuguga

SEQ ID NO: 29138 - RNA, 1620 nt, Artificial Sequence
  derived and/or modified sequence opt5 from VP1__Norovirus_and/or_Norovirus-like__U04469
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugagcaauuacgugcaggcuccccagggagaguucaccauuuccccuaacaauacacccggcgauauccucuuugaccugcagcuugggccucaccugaacccguuccucucucaucuggcccaaauguauaauggaugggugggcaacaugagagucaaagugcuucuggccggcaaugcuuuuaccgccgggaagauuaucaucagcugcauucccccuggauucgcggcccagaacaucuccauugcucaggccacaauguuuccccacguuaucgcugaugugcggguccucgaaccuauugaagugccccuggaggacguucgcaaugugcuguuccauaacaaugauucuagcccgaccaugagacucgucuguaugcuguacacgccucuucgggccuccggcucuagcuccgggaccgaccccuuugugaucgccggacgcgugcugacaugcccuagccccgauuucucuuuucucuuccugguucccccuaacgucgagcagaaaaccaagccguuuuccgugcccaaucuuccucugaacacacucagcaacucuagagugcccucccugauuaaugcuaugaugaucagccgggaccacggccaaaugguccaguuccagaacgggcgcgugacccuggauggacagcuccaaggcacgacaccuaccucccugucucagcuuuguaaaaucagaggcaagguuuuucaugcgagcgggggaaauggccugaaccucacagaacuggacggguccgccuaucacgcuuucgagagccccgccccgauuggauucccugauaucggcgacugcgacuggcacaugucugccaccgcuaccaauaacuuuacaggguccagcaaugaauaccagauucuuaucaagcaagagucugccuucgcgccccaucugggacacgugcaggcugauaaccucagcgccggcgccaauacggaccugauugucucccugucuuggaucagcccuguguccgaucagcaucggcacgacguugaucccugggugaucccucgcuauggcagcucucucaccgaggcugcccagcuggcucccccgauuuacccucccggguuuggagaagccaucgucuucuuuauguccgacuuccccguggucagcggcgugaacgggaugcggauuccuuguacacuuccgcaagaguauguugcgcacuuugugaaugaacaggcccccaccagaggagaggcugcccugcuccauuacgucgauccugacacacaccgcaaccugggcgaguucaaaauguaccccgaaggguuuaugaccugcgugccuaauucuuccggcagcggaccccagacgcuuccuaucaacggcguuuucacauuuguguccugggucucuagauucuaucagcugaagcccguggggaccgcuggaccggcccggcgccucuga

SEQ ID NO: 29139 - RNA, 1620 nt, Artificial Sequence
  derived and/or modified sequence opt5 from VP1__Norovirus_and/or_Norovirus-like__JN699049
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgauauccucuuugaccugcagcuugggccucaccugaauccguuccucucccaucuggcccaaauguauaacggaugggugggcaauaugaaagucaaggugcuucuggccggcaacgcuuuuaccgccgggaaaauuaucaucucuugcauucccccuggauucgcgagccagaauaucuccauugcccaggcuacaauguuuccccacguuaucgccgaugugagaguccucgaaccuauugaagugccccuggaggacguucggaacgugcuguuccauaauaacgauaauaccccgacgaugcgccucgucuguaugcuguacaccccucuuagagcuucuggcagcuccagcgggacagaccccuuugugaucgccggacgggugcugaccugcccuucucccgauuucuccuuucucuuccugguucccccuaacgucgagcagaagacaaaaccguuuagcgugcccaaccuuccucugaaugugcucucuaacucccgcguccccagccugauuaaguucaugauggugucucaagaccacggccagaugguucaguuucagaaugggagagugacccuggauggacaacuccagggcacgacaccuaccuccgccagccagcuguguaagaugcggggcacagucuaucaugcuuccgggggacaaggccuuaaccugaccgaaaucgacgggacccccuaccacgcguucgagucuccggccccuaucggauuccccgaucucggcgacagcgacuggcacauuaaugcuuccccugccacaacguuuaacaccggggaaagcgugaaacgccuggauauggagcagggaucuuccuucgcuccccaucuuggcacaguucacuauaccaaugccgacuacgaugccaacacagaccugaucugcagccucgaguggcugucuccucccagcggcgggaccccgaauaaggugaacccuugggcgauucccagauauggauccacgcugacagaagcugcccagcucgcucccccuaucuacccgcccggcuuuggggaggccauugucuucuuuaugucugauuucccuaucgccaauggacaggacggccugaaagugcccuguaccaucccucaagaauuugucacccauuucgugaacgagcaggcucccacacgcggggaagccgcgcuucugcacuacguugauccugacacccaccggaaucucggcgaguuuaagcuguaucccgagggauucaugacaugcgugccgaacagcuccggcagcgggccucagacgcuucccauuaauggagucuuuaccuucgugucuuggguuuccagauuuuaccagcugaaaccugugggcacaaccgggcccguccggcgccucuga

SEQ ID NO: 29140 - RNA, 1620 nt, Artificial Sequence
  derived and/or modified sequence opt5 from VP1__Norovirus_and/or_Norovirus-like__GQ856473
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgauauccucuuugaccugcagcuugggccucaccugaauccguuccucucccaucuggcccaaauguauaacggaugggugggcaauaugaaagucaaggugcuucuggccggcaacgcuuuuaccgccgggaaaauuaucaucucuugcauucccccuggauucgcggcccagaauaucagcauugcucaggccacaauguuuccccacguuaucgcugaugugagaguccucgaaccuauugaagugccccuggaggacguucggaacgugcuguuccauaauaacgauaauuccccgaccaugcgccucgucuguaugcuguacacgccucuuagagccucuggcagcuccagcgggaccgaccccuuugugaucgccggacgggugcugacaugcccuucucccgauuucuccuuucucuuccugguucccccuaacgucgagcagaagaccaaaccguuuagcgugcccaaccuuccucugaauacacucucuaacucccgcgugcccagccugauuaaugcuaugaugaucucuagagaccacggccaaaugguccaguuccagaacgggcgggugacccuggauggacagcuccaaggcacgacaccuaccucccugagccagcuuuguaagauccgcggcaagguuuuucaugcguccgggggaaauggccugaaccucacagaacuggacgggucugccuaucacgcuuucgagagccccgccccgauuggauucccugauaucggcgaaugcgacuggcacaugaaugccaccgcuaccuccaacuuuacagggagcaaugacgaguaccagauucuugugaaacaagagucuacguucgcgccccaucugggacacguccaggccgauucccucagcgcugacgccaacaccgaucugauggugucucugagcuggaucuccccuguuucugaccagcauagacgggauguggaccccugggucauuccucgcuauggcagcucccucacagaagccgcucagcuggcucccccgaucuacccucccggcuuuggggaggccaucguguucuuuaugagcgauuuccccgucgugucuggaguuaauggcaugcggauuccuuguacccuuccgcaagaauauguggcccacuuugucaacgagcaggcgcccacaagaggggaagccgcucugcuccacuacguggacccugauacccaucgcaaucugggagaguucaagauguaccccgagggcuuuaugacgugcguuccuaacuccagcgggucuggcccccagacacuuccuaucaauggagugcugaccuucgucuccugggugagcagauuuuaucagcucaaacccgugggcaccgccgggccggcucggcgccuguga

SEQ ID NO: 29141 - RNA, 1620 nt, Artificial Sequence
  derived and/or modified sequence opt5 from VP1__Norovirus_and/or_Norovirus-like__JN699050
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgauauccucuuugaccugcagcuugggccucaccugaauccguuccucucccaucuggcccaaauguauaacggaugggugggcaauaugaaagucaaggugcuucuggccggcaacgcuuuuaccgccgggaaaauuaucaucucuugcauucccccuggauucgcgagccagaauaucuccauugcccaggcuacaauguuuccccacguuaucgccgaugugagaguccucgaaccuauugaagugccccuggaggacguucggaacgugcuguuccauaauaacgauaauaccccgacgaugcgccucgucuguaugcuguacaccccucuuagagcuucuggcagcuccagcgggacagaccccuuugugaucgccggacgggugcugaccugcccuucucccgauuucuccuuucucuuccugguucccccuaacgucgagcagaagacaaaaccguuuagcgugcccaaccuuccucugaaugugcucucuaacucccgcguccccagccugauuaagucuaugauggugucccaagaccacggccagaugguucaguuccagaaugggagagugacccuggauggacaacuccagggcacgacaccuaccagcgccucccagcuguguaagaugcggggcacagucuaucaugcuucugggggacaaggccuuaaccugaccgaaaucgacgggacccccuaccacgcguuugagagcccggccccuaucggauuccccgauauuggcgacuccgacuggcacaucaaugcuagcccugccacaacguucgauucuggggaauccauuaaacgccucgacauggagcagggaagcucuuuugcuccccaucugggcaccgugcacuauacaaacgccgauuacccugccaauaccgaccuuaucugcagccuggaguggcucucucccccguccggcgggacaccuaacaagguuaaucccuggaccauucccagauauggaagcacgcugacagaagcggcucagcuggccccuccgaucuaucccccuggcuucggggaggccaucguguuuuucauguccgauuuucccauugcuaacggacaggacggccucaaagucccuuguaccaucccccaagaguucgugacccauuuugucaaugaacaggccccuacacgcggggaagcugcccugcuucacuacguggaucccgacacccaccggaaccugggcgaguucaagcucuacccggagggauuuaugacaugcguuccuaauagcucuggcuccgggccccagacgcugccuauuaacggaguguucaccuuugucagcugggugucuagauucuaccagcuuaaacccguuggcacaaccgggccggugcggcgccuguga

SEQ ID NO: 29142 - RNA, 1620 nt, Artificial Sequence
  derived and/or modified sequence opt5 from VP1__Norovirus_and/or_Norovirus-like__GQ856472
augaugauggccagcaaggacgcucccaccaacauggauggcacauccggggccggacagcuggugccugaggcgaauacggcugaaccgaucucuauggaccccgucgccggcgccgcuaccgccguugcuacagccgggcaaauuaacaugaucgauccuuggauuaugagcaauuucgugcaggcgccccagggagaguuuaccguguccccuaacaauacacccggcgacguccucuucgaucugcagcuugggccucaacugaacccguuucucgcccaccuggcucagauguacaauggaugggugggcaacaugagaguuaaagugcuucuggccggcaaugcuuucaccgccgggaagaucauuaucucuugcauucccccuggauuuacaagccagaacaucuccaucgcgcagaugaccauguucccccaugucauugccgacgugcggguucucgaaccuaucgagauuccccuggaagaugugcgcaauguccuguuucacacgaacgacaauagaccgaccaugcggcucguguguaugcuguauacaccucuucgcgcuaacggcucuagcuccgggaccgaucccuucgugaucgccggaagaguccugacaugcccugacagcaauuuuucuuuccucuuucugguuccucccaacguggagcagaaaacccggcccuucuccgugccgaacauuccccuuaauacgcugagcaacucucgcgucccuucccucaucaagagcaugacaaucucuagagaucaaaaucagauuauccaguuucaaaacggccgggugacccuggacgggcagcugcagggaacaacccccaccuccguuagccaacucuguaaaauucgcggcacaacguaccaugcuaccggcggguccggaaucaaucugacagagcuuaacggcgaaccuuaucacgccuucgagucucccgccccgauuggguucccugaucugggaggcugcgacuggcaucucaccgcuacacccacccaggcguuuaaugacggggccaagguggucagacugagcgugacgcagggagcugccuucgccccucaccuuggcacaauccacuacaccaccacagauaccgacuauaaccccaauacauccaucauuuguacgcuggauuggcucagccagaccacaggccaaucuaacguugacccuuggcagauccccaccuacggguccgcucugacagaagccgcgcagcuggcuccgccuauuuuuccucccggauucggcgagacccucguguuuuuccugagcgauuuucccaucucuaaugggaagaacggacuuagcgucccgugcacgcugccccaggaguucgugacccauuuugucaaugaacaagccccuauucggggcgaggccgcucuccugcacuauguggaccccgauacacaucgcaaccuuggggaguucaaacuguacccugaaggcuuuaugaccuguguucccaauacauccggaggcgggccucagacccuccccaucaacggaguguucgucuuugugucuuggguuagcagauucuaccagcugaagccggugggcacggccggggcugcccggcgccuguga

SEQ ID NO: 29143 - RNA, 1620 nt, Artificial Sequence
  derived and/or modified sequence opt5 from VP1__Norovirus_and/or_Norovirus-like__GQ856471
augaugauggccagcaaggacgcucccaccaacauggauggcacauccggggccggacagcuggugccugaggcgaauacggcugaaccgaucucuauggaccccgucgccggcgccgcuaccgccguugcuacagccgggcaaauuaacaugaucgauccuuggauuaugagcaauuucgugcaggcgccccagggagaguuuaccguguccccuaacaauacacccggcgacguccucuucgaucugcagcuugggccucaacugaacccguuucucgcccaccuggcucagauguacaauggaugggugggcaacaugagaguuaaagugcuucuggccggcaaugcuuucaccgccgggaagaucauuaucucuugcauucccccuggauuuacaagccagaacaucuccaucgcgcagaugaccauguucccccaugucauugccgacgugcggguucucgaaccuaucgagauuccccuggaagaugugcgcaauguccuguuucacacgaacgacaauagaccgaccaugcggcucguguguaugcuguauacaccucuucgcgcuaacggcucuagcuccgggaccgaucccuucgugaucgccggaagaguccugacaugcccugacagcaauuuuucuuuccucuuucugguuccucccaacguggagcagaaaacccggcccuucuccgugccgaacauuccccuuaauacgcugagcaacucucgcgucccuucccucaucaagagcaugacaaucucuagagaucaaaaucagauuauccaguuucaaaacggccgggugacccuggacgggcagcugcagggaacaacccccaccuccguuagccaacucuguaaaauucgcggcacaacguaccaugcuaccggcggguccggaaucaaucugacagagcuuaacggcgaaccuuaucacgccuucgagucucccgccccgauuggguucccugaucugggaggcugcgacuggcaucucaccgcuacacccacccaggcguuuaaugacggggccaagguggucagacugagcgugacgcagggagcugccuucgccccucaccuuggcacaauccacuacaccaccacagauaccgacuauaaccccaauacauccaucauuuguacgcuggauuggcucagccagaccacaggccaaucuaacguugacccuuggcagauccccaccuacggguccacacugaccgaagcugcccagcuggcgccgccuauuuuuccucccggauucggcgagacgcucguguuuuuccugagcgauuuucccaucucuaaugggaagaacggacuuagcgucccgugcacccugccccaggaguucgugacacauuuugucaaugaacaagcuccuauucggggcgaggccgcccuccugcacuaugcugaccccgauacccaucgcaaccuuggggaguucaaacuguacccugaaggcuuuaugacaugugugcccaauaccuccggaggcgggccucagacgcuccccaucaacggaguuuucguguuugucucuugggugagcagauucuaccagcugaagccgguuggcacagccggggcugcccggcgccuguga

SEQ ID NO: 29144 - RNA, 1620 nt, Artificial Sequence
  derived and/or modified sequence opt5 from VP1__Norovirus_and/or_Norovirus-like__JQ911594
augaugauggccagcaaggacgcucccaccaacauggauggcacauccggggccggacagcuggugccugaggcgaauacggcugaaccgaucucuauggaccccgucgccggcgccgcuaccgccguugcuacagccgggcaaauuaacaugaucgauccuuggauuaugagcaauuucgugcaggcgccccagggagaguuuaccguguccccuaacaauacacccggcgacguccucuucgaucugcagcuugggccucaacugaacccguuucucgcccaccuggcucagauguacaauggaugggugggcaacaugagaguuaaagugcuucuggccggcaaugcuuucaccgccgggaagaucauuaucucuugcauucccccuggauuuacaagccagaacaucuccaucgcgcagaugaccauguucccccaugucauugccgacgugcggguucucgaaccuaucgagauuccccuggaagaugugcgcaauguccuguuucacacgaacgacaauagaccgaccaugcggcucguguguaugcuguauacaccucuucgcgcuaacggcucuagcuccgggaccgaucccuucgugaucgccggaagaguccugacaugcccugacagcaauuuuucuuuccucuuucugguuccucccaacguggagcagaaaacccggcccuucuccgugccgaacauuccccuuaauacgcugagcaacucucgcgucccuucccucaucaagagcaugacaaucucuagagaucaaaaucagauuauccaguuucaaaacggccgggugacccuggacgggcagcugcagggaacaacccccaccuccguuagccaacucuguaaaauucgcggcacaacguaccaugcuaccggcgggaauggaaucaaccugacagagcuuaauggcgaaccuuaucacgccuucgagucccccgccccgauuggguucccugaucugggaggcugcgacuggcaucucaccgcuacacccacccaggcguuuaacgacggggccaagguggucagacugucugugacgcagggagcugccuucgccccucaccuuggcacaauccacuacaccaccacagauaccgacuauaaucccaacacaagcaucauuuguacgcuggauuggcucucccagaccgcuggccaaagcaauguugacccuuggcagauccccacauacgggucuacccugacagaagccgcgcagcuggcuccgccuauuuuuccucccggauucggcgagacccucguguuuuuccuguccgauuuucccaucagcaacgggaagaauggacuuucugucccgugcacgcugccccaggaguucgugacccauuuugucaacgaacaagccccuauucggggcgaggccgcucuccugcacuauguggaccccgauacacaucgcaaucuuggggaguucaaacuguacccugaaggcuuuaugaccuguguucccaacacaagcggaggcgggccucagacccuccccaucaacggaguguucgucuuuguguccuggguuucuagauucuaccagcugaagccggugggcacggccggggcugcccggcgccuguga

SEQ ID NO: 29145 - RNA, 1620 nt, Artificial Sequence
  derived and/or modified sequence opt5 from VP1__Norovirus_and/or_Norovirus-like__GU296356
augaugauggccagcaaggacgcuaccuccaacauggauggcacaucuggggccggacagcuggugcccgagaauaacaauacgagcgaaccuaucaacauggagccggucgcgggcgcuguuaccgccgccgcuacagccgggcaagugaauaugauugaccccuggaucaugaacaauuacgugcaggcuccucagggagaguucaccauuucccccaacaauacaccuggcgauauccucuuugaccugcagcuugggccccaccugaacccuuuccucgcccaucugucucaaauguauaauggaugggucggcaacaugaaagugagaguugugcuugcgggcaaugccuuuagcgcugggaagauuaucgucugcuguaucccgcccggauucuccgccccuaacauuucuaucgcucaggccaccauguuuccccacgugauugcggauguucgggugcuggaaccuaucgacauuccccucgaugacguccgcaaugugcuguuccauacaaacgauaacggcaaucagaccaugagacugcucugcaugcuguacacgccgcuucggagcgggggaaccuccagcggcacagacccuuuugugaucgccgggcgcguccugaccugucccacaccugauuucaacuuucucuuccugguuccucccaccguggaacagaaaacgaagcaauuuucugugcccaaucuuccgcugaacgucauguccaauagcagagugcccucucuccugaacgcuaugguuguguccccugaccaggcccaggucgugcaguuccaaaauggacggugcacacuggauggccagaugcucggcaccacaaccguuagcgcuucuuguguggcccgcuuuagagggaaaaccuuccaggcccccgacgaccggcugggaauuaaccuugcugagaucuccggcgagccuuaucacgcguucgaaagccccgccccgcugggguuuccugauuucggagacggcgauuggcaugucacagcuacgaagguggcccccucccaacucgaggccaaugacccugucgugguugggaacgugcagcccuacaauccucaguuugcuccccaccugggaacccuugucguggaaaacccgacaccuaaucagguugccaccggcacagaucuccuguucaacaucaccuggcugucuaaucgcgcgaacaacagauuuaaucccuggauuauccccaacuauggcagcacgcugacagaggcugcccaacucgccccuuccauuuucccgcccggguuuggagagaccaucguguacuucaauagcaccuuuccugcugucggcgccacaacccacgcugccauucccugccugcuuccucaggaguucguggcgcauuuugugaacgaacaggcccccauccgcggggaagcugcccugcuccacuauaucgacccugauacacaucggaaucugggagaguucaagauuuaccccgaaggcuuuguuacgugugucccgaacgucgggggcaccggaccucagucucuucccacaaauggcaucuucguguucguguccugggugagcagauacuaucaacugaaaccuguugggaccgcuuga

SEQ ID NO: 29146 - RNA, 1620 nt, Artificial Sequence
  derived and/or modified sequence opt5 from VP1__Norovirus_and/or_Norovirus-like__KM461693
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggauaacaucuccgcggcccagaucacgaugugcccucacgucauuguggacgugagacagcuggaacccguccugcucccgcugccugauauccggaaucgcuuuuuccauuauaaccaggaggacacccccagaaugcggcuuguugcuaugcuguacacaccucuccgcgccaauucuggggaagauguguuuaccgugagcuguagaguccugacacggcccgcucccgacuucgaguuuaccuuccuugugccuccgacaguugaguccaagaccaaacccuuuacgcugccuauucucacccugggagaacugagcaacucucgcuuccccgccgccaucgauaugcucuauacagacccuaacgaguccauugugguccaaccccagaauggcagaugcacccuggaugggacacuucagggaaccacgcagcuggugccgacacaaaucugugcuuuucggggcacccucauuagccagaacgcgcgcgccgcugaccugacagauucuccucagagagcccggaaucacccccuucauguucaagugaagaaccuggacgggacccaguacgacccuaccgaugacauccccgccguccucggagcuaucgauuucaaaggcacaguguucggcgucgccucccagcgcgacgugagcgggacgcaggaacaaggacacuaugcgaccagagcucacgaggcccauauugauacaaccgacccuaaguacgcccccaagcugggcacaauccugauuaaaucugaauccaccgauuuuacgacaaaucagccgauccgguucaccccuguugggaugggagacaacaauuggagacagugggagcuccccgauuacagcggcucccugacccuuaacaugaaucuggcucccgccgugucuccuagcuuuccgggggagcgcauucucuucuuucgguccaucguccccagcgcuggaggcuauggcucuggguacaucgacugccugauuccucaggaaugggugcaacacuucuaucaggaggccgcgcccucccagagcgccguugcucuugugagauacgucaacccugauacaggacgcaauaucuuugaagccaagcugcaucgggagggcuuccucaccguggcuaacucugggaauaaccccaugggagugccucccaauggcuauuuuagauucgaagccuggguuaaccaguuuuacacacuggcgccguga

SEQ ID NO: 29147 - RNA, 1620 nt, Artificial Sequence
  derived and/or modified sequence opt5 from VP1__Norovirus_and/or_Norovirus-like__LC145789
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaaguucacgcccguggggcucaacgauacagaccauuuuaaucaguggguugugccucgcuaugccggagcucugaaccuuaauaccaaccuggccccgagcgucgcgcccguguucccuggcgaaagacuccuguuuuuccgguccuacaucccccuuaaaggcggguauggaaccccugcuauugauugccugcucccccaagagugggugcagcacuuuuaccaggaggccgccccuucuaugagcgaaguugcucugguccgcuauaucaaucccgacacaggcagagcccuguucgaggcuaagcuccaccgggccggguuuaugaccguguccagcaacacaucugcgccgguggucgugccugccaacggauacuucagauuugauuccuggguuaaucaguucuauagccuggcucccaugggcacggggaacggccgccgguga

SEQ ID NO: 29148 - RNA, 1617 nt, Artificial Sequence
  derived and/or modified sequence opt5 from VP1__Norovirus_and/or_Norovirus-like__KX171417
augaagauggccagcaacgacgcugcccccuccaaugauggcgcggcugggcuggugccugagggaaacaaugaaacccucucucuggagccggucgccggcgccgcuaucgccgcucccguuacagggcagaacaauauuaucgacccuuggauuagaacgaacuucgugcaagcccccaauggagaauuuaccgugagcccucggaacucccccggcgagauccuucugaaucucgaacuggggccugaucuuaacccguaccuggcgcaccucucucgcauguauaauggauacgccggcggcgucgaggugcagguucugcuggcugggaacgccuucacagcuggaaaaauucucuuugccgcggugcccccuaauuuccccgucgaguuucugagcccugcccagaucaccaugcuuccccaucugaucguggacguuagaacacucgaaccgauuaugaucccucugcccgaugugcggaacaccuucuuucacuauaauaaccagccuaacucccgcaugagacuugucgcuaugcuguacacaccccuccggucuaauggcagcggggacgauguguucaccguguccugccgcguccugacgagacccaccccugacuuugaguucacauaucugguuccgcccagcguggaaucuaagaccaaaccuuuuucccuccccauucugacacuuagcgagcugaccaacucucgguucccugugcccaucgauucccucuuuacggcccaaaauaacguccuucaggugcagugucagaauggacgcugcacacuugacggcgagcugcaagggaccacacagcuccugccgagcggaauuugugcuuucagaggccggguuaccgccaagaccgaucauucugacaaauggcacaugcagcugcagaaccucaauggcacaacguacgauccuaccgacgacgugcccgccccucuggggacacccgauuucaagggagucguguuuggcguugcuucccaacgcaacguggggaaugacgcgccuggaagcaccagagcccaugaagcugucaucuccacauauucuccccaguucgugccgaagcugggcagcgucaacuuucgguccaaugaugacgauuuccagcugcaaccuaccaaauuuacgcccgugugcauuaacgacgaugacgaucaccccuuccgccagugggagcucccugacuacagcgggcugcuuacacugaauaugaaccucgccccgcccguugccccuaauuuucccggagaacagcugcuguucuuuagaucuuucgugccuuguuccggcggcuacaaccaggggaucgucgauugccucaucccccaagaguggauucagcacuuuuaucaggaaagcgcuccuucucagagcgagguggcccugauccgguacguuaaccccgacaccggaagaacccuuuucgaggcgaagcugcaucgcuccggcuauauuacaguggcucacucuggggacuacccgcucgucgugccugccaauggauauuuucgguucgauagcugggugaaccaauucuacucccuggcccccaugggcaccgggaauggcagacgccgggcucaguga

SEQ ID NO: 29149 - RNA, 1617 nt, Artificial Sequence
  derived and/or modified sequence opt5 from VP1__Norovirus_and/or_Norovirus-like__KX171412
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauaauaaccagcccaacagccgcaugagacuugucgcuaugcuguacacaccccuccgguccaauggcucuggggacgauguguucaccgugagcugccgcguccugacgagaccuaccccggacuuugaguucacauaucugguucccccuuccguggaaagcaagaccaaacccuuuucucucccuauucugacacuuuccgagcugaccaacagccgguuccccgugccgaucgauucucucuuuacggcccaaaauaacguccuucaggugcagugucagaauggacgcugcacacuugacggcgagcugcaagggaccacacagcuccugccuuccggaauuugugcuuucagaggccggguuaccgccgaaaccgaucaucacgacaaguggcauaugcagcugcagaaccucaauggcacaacguacgaucccaccgacgacgugccugcuccccuggggacaccugauuucaaaggagucguguuuggcguugccagccaacgcaacguggggaaugacgcgcccggaucuaccagagcccacgaggcugucaucuccacauauagcccgcaguucgugccuaagcugggcuccgucaacuuucggucuaaugaugacgauuuccagcugcaacccaccaaguuuacgcccguggggauuaacgacgauggagaccacccuuuccgccagugggaacucccggauuacagcggccugcuuacacugaauaugaaccucgcucccccuguugcccccaauuuuccuggcgagcagcugcuguucuuuagauccuucgugcccugcagcgggggauacaaccagggcaucgucgacugucucaucccucaagaauggauucagcauuuuuaucaggagucugcccccucccagagcgauguggcccugauccgguacguuaacccggacaccgggagaacccuuuucgaggcgaaacugcaccgcucuggauauauuacaguggcucauagcggcgacuacccucucgucgugcccgccaauggguauuuucgguucgauuccugggugaaccaauucuacucucuggccccuaugggcaccggaaauggcagacgccgggcucaguga

SEQ ID NO: 29150 - RNA, 1617 nt, Artificial Sequence
  derived and/or modified sequence opt5 from VP1__Norovirus_and/or_Norovirus-like__KU557839
augaagauggccagcaacgacgcugcccccuccucugauggcgcggcugggcuggugccugagggaaauaacgaaacccucccgcuggagcccgucgccggcgccgcuaucgccgcuccuguuacagggcagaauaacauuaucgaccccuggauuagaacgaauuucgugcaagccccuaacggagaauuuaccgugagcccccgcaauuccccuggcgagauccuucugaaccucgaacuggggccggaucuuaaucccuaccuggcgcaccucucucggauguauaacggauacgccggcggcgucgaggugcagguucugcuggcugggaaugccuucacagcuggaaaaauucucuuugccgcggugccucccaacuucccugucgaguuucugagccccgcccagaucaccaugcuuccgcaucugaucguggacguuagaacacucgaaccuauuaugaucccccugccugaugugcggaauaccuucuuucacuauaacaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgccgaaaccgaucaucgcgacaaguggcacaugcagcugcagaaucucaacggcacaacguacgaucccaccgacgacgugccugcuccccuggggacaccugauuucaaaggagucguguuuggcguugccucucaaagaaauguggggaacgacgcgcccggauccacccgggcccaugaggcugucaucagcacauauuccccgcaguucgugccuaagcugggcucugucaauuuucgcagcaacgauaaugacuuccagcugcaacccaccaaguuuacgcccguggggauuaacgaugacggagaucacccuuucagacagugggaacucccggacuacuccggccugcuuacacugaauaugaaccucgcucccccuguugcccccaauuuuccuggcgagcagcugcuguucuuucggagcuucgugcccugcucugggggauacaaccagggcaucgucgauugucucaucccucaagaauggauucagcacuuuuaucaggaguccgcccccagccagucugacguggcccugaucagauacguuaacccggauaccgggcgcacccuuuucgaggcgaaacugcaucggagcggauauauuacaguggcucacuccggcgacuacccucucgucgugcccgccaauggguauuuuagauucgacucuugggugaaccaauucuacagccuggccccuaugggcaccggaaauggccgccggagagcucaguga

SEQ ID NO: 29151 - RNA, 1617 nt, Artificial Sequence
  derived and/or modified sequence opt5 from VP1__Norovirus_and/or_Norovirus-like__KP902564
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauaauaaccagcccaacagccgcaugagacuugucgcuaugcuguacacaccccuccgguccaauggcucuggggacgauguguucaccgugagcugccgcguccugacgagaccuaccccggacuuugaguucacauaucugguucccccuuccguggaaagcaagaccaaacccuuuucucucccuauucugacacuuuccgagcugaccaacagccgguuccccgugccgaucgauucucucuuuacggcccaaaauaacguccuucaggugcagugucagaauggacgcugcacacuugacggcgagcugcaagggaccacacagcuccugccuuccggaauuugugcuuucagaggccggguuaccgccgaaaccgaucaucgcgacaaguggcacaugcagcugcagaaccucaauggcacaacguacgaucccaccgacgacgugccugcuccccuggggacaccugauuucaaaggagucguguuuggcguugccagccaaagaaacguggggaaugacgcgcccgauucuacccgggcccaugaggcugucaucuccacauauagcccgcaguucgugccuaagcugggauccgucaacuuucgcucuaaugacaacgauuuccagcugcaacccaccaaguuuacgcccgugggcauuaaugacgauggggaccacccuuucagacagugggaacucccggauuacagcggacugcuuacacugaacaugaaucucgcucccccuguugcccccaacuuuccuggcgagcagcugcuguucuuucgguccuucgugcccugcagcggcggguacaaccagggaaucgucgacugucucaucccucaagaauggauucagcacuuuuaucaggagucugcccccucccagagcgauguggcccugaucagauacguuaauccggacaccggccgcacccuuuucgaggcgaaacugcaucggucuggguauauuacaguggcucacagcggagacuacccucucgucgugcccgccaacggcuauuuuagauucgauuccugggugaaucaauucuacucucuggccccuauggggaccggcaacggacgccggagagcucaguga

SEQ ID NO: 29152 - RNA, 1617 nt, Artificial Sequence
  derived and/or modified sequence opt5 from VP1__Norovirus_and/or_Norovirus-like__KU587625
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcauaucauuguggacguuagaacacuggaaccuaucaugauuccccucccugaugugcggaacaccuucuuucacuauaauaaccagcccaacagccgcaugagacuggucgcuaugcuuuacacaccccugcgguccaauggcucuggggacgauguguucaccgugagcugccgcguccucacgagaccuaccccggacuuugaguucacauaucugguucccccuuccguggaaagcaagaccaaacccuuuucucugccuauccucacacuguccgagcuuaccaacagccgguuccccgugccgauugauucucuguuuacggcccaaaauaacguccuccaggugcagugucagaauggacgcugcacacuggacggcgagcuucaagggaccacacagcugcucccuuccggaaucugugcuuucagaggccggguuaccgccgaaaccgauaaccccgacaaguggcauaugcagcugcagaaucugaacggcacaacguacgauccuaccgacgacgugcccgccccucucgggacacccgauuucaaaggagucguguuuggcguugcuagccaacgcaauguggggaacgacgcgccgggaucuaccagagcccacgaggcugucauuuccacauauagcccuaaguucgugcccaagcugggcuccgucaauuuucggucuaacgaugacgauuuccagcuucagcccacccgcuuuacgccuguggggaucaaugacgauggaaaccauccguucagacaaugggaacugcccgacuacagcggcguucucacacugaauaugaaccuugccccucccguggccccuaacuuucccggcgagcagcugcuccuguuccgguccuuugucccuugcagcgggggauacaaucagggcaucauugauugucugaucccccaggaauggauucaacacuucuaucaggagucugcuccgucccagagcgacguggcccucaucagauacguuaacccugauaccgggcgcacccuguuugaggcgaaacuucaccggucuggauauauuacaguggcucauagcggcgacuacccccuggucgugccugccaauggguauuucagauuugacuccugggugaaccaguucuacucucucgcccccaugggcaccggaaauggccgccggagagcucaauga

SEQ ID NO: 29153 - RNA, 1617 nt, Artificial Sequence
  derived and/or modified sequence opt5 from VP1__Norovirus_and/or_Norovirus-like__KX171413
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauaauaaccagcccaacagccgcaugagacuugucgcuaugcuguacacaccccuccgguccaauggcucuggggacgauguguucaccgugagcugccgcguccugacgagaccuaccccggacuuugaguucacauaucugguucccccuuccguggaaagcaagaccaaacccuuuucucucccuauucugacacuuuccgagcugaccaacagccgguuccccgugccgaucgauucucucuuuacggcccaaaauaacguccuucaggugcagugucagaauggacgcugcacacuugacggcgagcugcaagggaccacacagcuccugccuuccggaauuugugcuuucagaggccggguuaccaccgaaacagaucaucgcgacaaguggcacaugcagcugcagaaccucaauggcacgaccuacgaucccacagacgacgugccugcuccccuggggaccccugauuucaaaggagucguguuuggcguugccagccaaagaaacguggggaaugacgcccccggaucuacacgggcgcaugaggccgucaucuccaccuauagcccgcaguucgugccuaagcugggcuccgucaacuuucgcucuaaugaugacgauuuccagcugcaacccacgaaguuuacacccguggggauuaacgacgauggagaccacccuuucagacagugggaacucccggauuacagcggcccccugacccuuaauaugaaccuggcuccucccguugccccuaauuuucccggcgagcagcuccuguucuuucgguccuucgugccuugcagcgggggauacaaccagggcaucgucgacugucugaucccccaagaauggauucagcacuuuuaucaggagucugccccgucccagagcgauguggcucucaucagauacguuaacccugacaccgggcgcacacuguucgaggccaaacuucaucggucuggauauauuaccguggcgcacagcggcgacuacccccuggucgugccugcuaauggguauuuuagauucgauuccugggugaaccaauucuacucucucgcccccaugggcacaggaaauggccgccggagagcccaguga

SEQ ID NO: 29154 - RNA, 1617 nt, Artificial Sequence
  derived and/or modified sequence opt5 from VP1__Norovirus_and/or_Norovirus-like__KP902565
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauaauaaccagcccaacaaucgcaugagacuugucgcuaugcuguacacaccccuccggagcaacggcuccggggacgauguguucaccgugucuugccgcguccugacgagaccuaccccggacuuugaguucacauaucugguucccccuagcguggaauccaagaccaaacccuuuagccucccuauucugacacuuucugagcugaccaauucccgguuccccgugccgaucgauagccucuuuacggcccaaaacaauguccuucaggugcagugucagaacggacgcugcacacuugacggcgagcugcaagggaccacacagcuccugccuucuggaauuugugcuuucagaggccggguuaccgccgaaaccgaucaucgcgacaaguggcacaugcagcugcagaaucucaacggcacaacguacgaucccaccgacgacgugccugcuccccuggggacaccugauuucaaaggagucguguuuggcguugccucccaaagaaauguggggaacgacgcgcccggaagcacccgggcccaugaggcugucaucucuacauauuccccgcaguucgugccuaagcugggcagcgucaauuuucgcuccaacgauaaugacuuccagcugcaacccaccaaguuuacgcccguggggauuaacgaugacggagaucacccuuucagacagugggaacucccggacuacucuggccugcuuacacugaauaugaaccucgcucccccuguugcccccaacuuuccuggcgagcagcugcuguucuuucggagcuucgugcccugcuccgggggauacaaucagggcaucgucgauugucucaucccucaagaauggauucagcacuuuuaucaggagagcgcccccucucaguccgacguggcccugaucagauacguuaacccggauaccgggcgcacccuuuucgaggcgaaacugcaucggagcggauauauuacaguggcucacucuggcgacuacccucucgucgugcccgccaauggguauuuuagauucgacagcugggugaaccaauucuacucccuggccccuaugggcaccggaaauggccgccggagagcucaguga

SEQ ID NO: 29155 - RNA, 1617 nt, Artificial Sequence
  derived and/or modified sequence opt5 from VP1__Norovirus_and/or_Norovirus-like__KX171416
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauaauaaccagcccaacaaucgcaugagacuugucgcuaugcuguacacaccccuccggagcaacggcuccggggacgauguguucaccgugucuugccgcguccugacgagaccuaccccggacuuugaguucacauaucugguucccccuagcguggaauccaagaccaaacccuuuagccucccuauucugacacuuucugagcugaccaauucccgguuccccgugccgaucgauagccucuuuacggcccaaaacaauguccuucaggugcagugucagaacggacgcugcacacuugacggcgagcugcaagggaccacacagcuccugccuucuggaauuugugcuuucagaggccggguuaccgccgaaaccgaucaucgcgacaaguggcacaugcagcugcagaaucucaacggcacaacguacgaucccaccgacgacgugccugcuccccuggggacaccugauuucaaaggagucguguuuggcaucgccucccaaagaaauguugggaacgacgcgcccggaagcacccgggcccaugaggcugugauuucuacauauuccccgcaguucgucccuaagcugggcagcgugaauuuucgcuccaacgauaaugacuuccagcugcaacccaccaaguuuacgcccgucgggaucaacgaugacggagaucacccuuucagacagugggaacucccggacuacucuggccugcuuacacugaauaugaaccucgcucccccuguggcccccaacuuuccuggcgagcagcugcuguucuuucggagcuucguucccugcuccgggggauacaaucagggcaucguggauugucucauuccucaagaauggauccagcacuuuuaucaggagagcgcccccucucaguccgacgucgcccugauuagauacgugaacccggauaccgggcgcacccuuuucgaggcgaaacugcaucggagcggauauaucacaguugcucacucuggcgacuacccucucgugguccccgccaauggguauuuuagauucgacagcugggugaaccaauucuacucccuggccccuaugggcaccggaaauggccgccggagagcucaguga

SEQ ID NO: 29156 - RNA, 1617 nt, Artificial Sequence
  derived and/or modified sequence opt5 from VP1__Norovirus_and/or_Norovirus-like__KU561250
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauaauaaccagcccaacagccgcaugagacuugucgcuaugcuguacacaccccuccgguccaauggcucuggggacgauguguucaccgugagcugccgcguccugacgagaccuaccccggacuuugaguucacauaucugguucccccuuccguggaaagcaagaccaaacccuuuucucucccuauucugacacuuuccgagcugaccaacagccgguuccccgugccgaucgauucucucuuuacggcccaaaauaacguccuucaggugcagugucagaauggacgcugcacacuugacggcgagcugcaagggaccacacagcuccugccuuccggaauuugugcuuucagaggccggguuaccgccgaaaccgaucaucgcgacaaguggcacaugcagcugcagaaccucaauggcacaacguacgaucccaccgacgacgugccugcuccccuggggacaccugauuucaaaggagucguguuuggcguugccagccaaagaaacguggggaaugacgcgcccggaucuacccgggcccaugaggcugccaucuccacauauagcccgcaguucgucccuaagcugggcuccgugaacuuucgcucuaaugauaacgacuuccagcugcaacccaccaaguuuacgcccgucgggauuaaugaugacggagaucacccuuucagacagugggaacucccggacuacagcggccugcuuacacugaacaugaaucucgcucccccuguggcccccaacuuuccuggcgagcagcugcuguucuuucgguccuucguucccugcagcgggggauacaaccagggcaucguggauugucucaucccucaagaauggauucagcacuuuuaucaggagucugcccccucccagagcgacgucgcgcugaucagauacgugaauccggauaccgggcgcacccuuuucgaggcuaaacugcaucggucuggauauauuacaguugcccacagcggcgacuacccucucgugguccccgccaacggguauuuuagauucgacuccugggugaaucaauucuacucucuggcuccuaugggcaccggaaacggccgccggagagcccaguga

SEQ ID NO: 29157 - RNA, 1617 nt, Artificial Sequence
  derived and/or modified sequence opt5 from VP1__Norovirus_and/or_Norovirus-like__KU561251
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauaauaaccagcccaacagccgcaugagacuugucgcuaugcuguacacaccccuccgguccaauggcucuggggacgauguguucaccgugagcugccgcguccugacgagaccuaccccggacuuugaguucacauaucugguucccccuuccguggaaagcaagaccaaacccuuuucucucccuauucugacacuuuccgagcugaccaacagccgguuccccgugccgaucgauucucucuuuacggcccauaauaacguccugcaagugcagugucagaauggacgcugcacacuugacggcgagcugcaggggaccacacaacuccugccuuccggaauuugugcuuucagaggccggguuaccgccgaaaccgaucaccgcgacaaguggcauaugcagcugcagaaccucaauggcacaacguacgaucccaccgacgacgugccugcuccccuggggacaccugauuucaaaggagucguguuuggcguugccagccagagaaacguggggaaugacgcgcccggaucuacccgggcccacgaggcugucaucuccacauauagcccgcaauucgugccuaaacuuggcuccgucaacuuucgcucuaaugauaacgacuuccagcugcagcccaccaaguuuacgcccguggggauuaaugaugacggagaucacccuuucagacaaugggaacucccggacuacagcggccugcuuacacugaacaugaaucucgcucccccuguugcccccaacuuuccuggcgagcagcugcuguucuuucgguccuucgugcccugcagcgggggauacaaccagggcaucgucgauugucucaucccucaggaauggauucaacauuuuuaucaggagucugcccccucccagagcgacguggcccugaucagauacguuaauccggauaccgggcgcacccuuuucgaggcgaagcugcaccggucuggauauauuacaguggcucauagcggcgacuacccucucgucgugcccgccaacggguauuuuagauucgacuccugggugaaucaguucuacucucuggccccuaugggcaccggaaacggccgccggacagcucaauga

SEQ ID NO: 29158 - RNA, 1617 nt, Artificial Sequence
  derived and/or modified sequence opt5 from VP1__Norovirus_and/or_Norovirus-like__AB810014
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuuccgcggcauccuguaugggguccucacgcaggauaauguguccgaaggaaccggcgaggccaagaacgcuaaagggguuuacauuucuacaaccagcggaaaguuuacaccgaagaucggcuccauugggcugcauagcaucaccgaaaaugugcacccuaaccagcaaucuagauucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuucggucccgcguucccugcgugcaggggcucagaggacaggacgccuucaucgauugucugcugccucaggaaugggucaaucacuuuuaccaagaggcugcccccagccaggcugacguggcccucauucgguauguuaacccugauacaggcagaacccuguucgaagcgaaacuucaccgcucuggguuuaucacagugagccauacgggagccuacccccuggucgugccgccuaacggccacuuccgguuugacuccugggugaaucaguucuauucucucgcucccauggggaccggcaacggaagauga

SEQ ID NO: 29159 - RNA, 1617 nt, Artificial Sequence
  derived and/or modified sequence opt5 from VP1__Norovirus_and/or_Norovirus-like__AB809985
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccgcggacaggacgccuucaucgauugucugcugccucaggaaugggucaaucacuuuuaccaagaggcugcccccucucaggcugacguggcccucauuagauauguuaacccugauacaggccggacccuguucgaagcgaaacuucacagaagcggguuuaucacagugucccauacgggagccuacccccuggucgugccgccuaacggccacuuccgcuuugacucuugggugaaucaguucuauagccucgcucccauggggaccggcaacggacgguga

SEQ ID NO: 29160 - RNA, 1617 nt, Artificial Sequence
  derived and/or modified sequence opt5 from VP1__Norovirus_and/or_Norovirus-like__AB810003
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaaccgcggggauaauugggaccagaaccuucugcagcucaccuacccuucuggagcuuccuacgaucccaccgacgaggugccugcgccccugggcacacaagacuucagcggcauccuguaugggguccucacgcaggauaauguguccgaaggaaccggcgaggccaagaacgcuaaagggguuuacauuucuacaaccagcggaaaguuuacaccgaagaucggcuccauugggcugcauagcaucaccgaaaaugugcacccuaaccagcaaucuagauucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuucggucccgcguucccugcgugcaggggcucagaggacaggacgccuucaucgauugucugcugccucaggaaugggucaaucacuuuuaccaagaggcugcccccagccaggcugacguggcccucauucgguauguuaacccugauacaggcagaacccuguucgaagcgaaacuucaccgcucuggguuuaucacagugagccauacgggagccuacccccuggucgugccgccuaacggccacuuccgguuugacuccugguucaaucaguuuuauucucucgcucccauggggaccggcaacggaagauga

SEQ ID NO: 29161 - RNA, 1617 nt, Artificial Sequence
  derived and/or modified sequence opt5 from VP1__Norovirus_and/or_Norovirus-like__AB809975
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucuccuacccuagcggagcuuccuacgaucccaccgacgaggugccugcgccccugggcacccaagacuucucuggcauccuguaugggguccucacacaggauaaugugagcgaacgcacgggagaggccaagaacgcuaaaggcauuuacaucuccaccacaagcgggaaguuuaccccgaagauuggaucuaucggccugcauuccaucacagaaaauguucacccuaaccagcaaagcagauucacccccgugggggucgcccagaaugagaacacgcccuuccagcagugggugcuuccucauuaugccggagcucuggcccucaauacaaaccuggcgccggcugucgcccccaccuuuccuggcgagcaacuucuguucuuucggucucgcgugcccugcguucagggccuccaggggcaggacgccuucauugauugucugcugccucaagaaugggugaaucacuuuuaccaggaggcugcccccagccaggcugacgucgcccucaucagauaugugaacccugauaccggacggacacuguucgaagcgaaacuucacagauccggcuuuauuaccguuucucauacaggggccuacccccugguggucccgccuaacggacacuuccgcuuugacagcugggugaaucaguucuauucccucgcucccaugggcacggggaacggccgguga

SEQ ID NO: 29162 - RNA, 1617 nt, Artificial Sequence
  derived and/or modified sequence opt5 from VP1__Norovirus_and/or_Norovirus-like__JX401280
augaagauggccagcuccgacgcuaaccccucugauggcagcuccgccaaucuggugccugaggucaacaaugaaguuauggcgcucgagccgguggugggggcugccaucgccgcucccgucgccggacagcaaaacaucaucgacccuuggauuagaaauaacuucgugcaggcucccggcggggaauuuaccguuucuccucggaaugcccccggagagauccuguggagcgcgccucuuuccccggaucugaaccccuaccucucucaccugagccgcauguauaauggcuacgccgggggauucgaagugcaggucauucuugcuggcaacgccuuuacagcuggcaaaaucguguucgccgcgguuccucccaauuuuccuacggaggggcugucccccagccaggugaccauguucccgcauaucauugucgacgugagacaacucgagccugugcugaucccccugccugauguccggaacaauuuuuaucacuacaaccaggccaaugacucuacacucaagcugauugcuaugcuuuauacaccccugcgcgccaacaacgcuggagaugacguuuucaccguguccugcagagugcucacccggcccagcccugauuuugacuucaucuuucuggucccgcccacaguggaaucucgcaccaaaccuuucacgguucccgugcuuaccgucgaggaaaugacaaauuccagauuuccuauuccccuggagcgccucuucaccggcccgagcacagccuucgugguucagccucagaacgggcgguguaccacggauggagugcugcugggcacaacccaacucucugccgucaauaucugcaacuuuagaggggaggugaaucauauugcuggaacacacgacuacaccaugcggcugaccucccagaacuggaauaacuaugaucccacagaagagaucccugcgccccuuggcacgccugacuucgucggccgcauccagggggugcugacccagacaaccagaagcgacggauccacacggucucauaaggccaccguuagcacgggcuccgugcacuuuacacccaaacucgggagcguccaauucaccaccgauacaaccaaugaccugaacgcuggacagaauacaaaguuuacgccggugggcguugaacagaccucuggggaucaccaauccgagccucagcaguggacacuucccaacuacagcggaacccccaaucauaacgugcaccuggccccugccgucgcuccgacauuccccggcgaacagcuccuguuuuuccgcucuacccugccuggcugugggggauaccccaauaugaaccucgacugccugcuuccucaagagugggugcugcauuuuuaucaggaggccgcgcccgcucagagcgauguggcccuccugagauucguuaacccugacacgggccggguccuuuuugaauguaagcugcacagauccggguucauuaccguggcccacucuggaagccaugaucucgugauucccccgaauggcuacuuucgcuucgacuccugggucaaccaguucuauacacuggcuccuauggggaauggcagcggacggagacgcguguga

SEQ ID NO: 29163 - RNA, 1617 nt, Artificial Sequence
  derived and/or modified sequence opt5 from VP1__Norovirus_and/or_Norovirus-like__KC962462
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagucccugucucccagccaggugaccauguucccgcauaucauugucgacgugagacaacucgagccugugcugaucccccugccugauguccggaacaauuuuuaucacuacaaccaguccaaugaccccacaauuaagcucaucgccaugcuguauacaccccuucgcgcuaacaacgccggagaugacguuuucaccgugagcugcagagugcugacccggccuucuccggauuuugacuucauuuuucucgugcccccuacagucgaaucccgcaccaaacccuucagcguuccuauccugacgguggaggaaaugaccaauucuagauuucccauuccgcuugagaagcuguucacaggcccuuccagcgccuucgucgugcagccccagaacgggcgguguaccaucgauggaguucuccugggcacaacccaacugucuccugugaauaucugcacguuucgcggggacgucacacauauugcuggaacccacaacuacacaaugaaucucgcgacccagaacuggaacuccuaugaucccaccgaggaaaucccugcuccccugggcacaccggacuucgugggcaaaauucaggggguccuuacgcagaccacaaagaccgacggaagcacaagaggccauaaggccaccguguguaucggguccgccgauuuugccccuaaacugggacggguucaauucgagacggacacaaauaaugaucucgaaaccaaccagaauaccaaguuuacacccgugggcgucauucagaacggggagaccgcucaccgcaaugaaccccaacagugggugcugccuucuuacagcggaagaaacacaccgaauguucaccuugcccccgcgguggcuccuacguuccccggcgagcagcugcucuuuuuccgguccaccaugccuggcugcagcggguaccccaacauggaccuggauugucugcucccucaggaguggguccaauauuuuuaccaggaagccgcccccgcucagucugacguggcccugcuucgcuucgugaacccggauacaggaagaguucuguuugagugcaaacuccauaaguccggcuaugucaccguggcucacacagggagccaugaccuggugaucccucccaauggauacuuccgguuugauucuugggucaaccaguucuauacccuugccccuaugggcaaugggacgggcagacgccgguga

SEQ ID NO: 29164 - RNA, 1617 nt, Artificial Sequence
  derived and/or modified sequence opt5 from VP1__Norovirus_and/or_Norovirus-like__KX353974
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucacgguucccauccugaccguggaggaaaugacaaauagcagauuuccuauuccccuugagaagcuguucaccgggccgucuuccgccuucgucgugcagccucagaacggacgguguacaaccgauggcguucuccuggggacgacacaacugagccccgugaauaucugcaccuuucgcggagacgucacacauaucgcuggcucuagaaacuacaccaugaaucucgcgucccugaacuggaauaacuaugauccuaccgaggaaauucccgccccucuuggcacacccgacuucguggggaaaauccagggaguccugacgcagaccacaaagggcgacgggagcacccggggacacaaggcuacaguguacaccggcuccgccgauuuuacgccgaaacucgggucuguucaguucggaacagacaccgagaaugauuuugaaauucaucaaaacacccgcuucacaccugugggcgucauccaggacggcagcaccacacacagaaaugagccccagcaaugggugcugcccuccuacagcgggcggucuguucacaacgugcaucuugccccugcugucgccccgaauuuucccggagaacagcuccuguucuuucgcuccacgaugccuggcuguagcggguaucccaacauggaucuggacugccugcucccucaggagugggugcagcacuucuaccaagaggcggcucccgcccagucugauguggcccugcuuagauuuguuaauccugacaccggacggguccuguucgaauguaagcuccauaaaagcggcuaugugacaguggcucacaccgggcagcacgaucuggucauucccccgaacggcuacuuuagauucgacuccugggugaaccaguucuauacacuugccccuaugggaaauggcaccgggcgccggagauga

SEQ ID NO: 29165 - RNA, 1617 nt, Artificial Sequence
  derived and/or modified sequence opt5 from VP1__Norovirus_and/or_Norovirus-like__KF060122
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccugugcugacggucgaggaaaugaccaauagcagauuucccgugccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucucacaacuacaccaugaaucucgcuucccagaacuggaauagcuaugaucccaccgaggaaaucccugcgccccugggcacaccggacuucguggggaaaauccagggaguucuuacgcagaccacaagagccaacggcuccacccgggggcauaaggcuacaguguacaccggaucugccgacuuugccccuaagcugggccgcguccaauucgcuacggauacaaauaacgacuuugaugccaaucagaacaccaaauucacccccguggggguuauucaggacggagauacagcgcacagaaaugagccccaacagugggugcucccuagcuacuccggccggaacagccacaauguccaucuggcuccggccguggcccccaccuuuccuggcgaacagcuucuguucuuucgcucuacaaugcccggguguuccggauauccuaacauggaccucgauugccugcugccccaggagugggugcaauacuucuaucaggaagcugccccugcucagagcgacguugcccuccugagauuugucaaccccgauacgggccgggugcuuuucgaguguaagcugcacaaaucuggguacgugaccgucgcgcauacaggacagcacgaccucgugaucccgccuaauggcuauuuuagauucgauagcuggguuaaccaauucuacacccuggcccccauggggaauggcacaggacgccggagauga

SEQ ID NO: 29166 - RNA, 1617 nt, Artificial Sequence
  derived and/or modified sequence opt5 from VP1__Norovirus_and/or_Norovirus-like__KR904234
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauagcgcuggcgaugacguuuucaccgugucuugcagagugcugacacggccuuccccggauuuugacuucauuuuucucgugcccccuaccgucgaaagccgcacgaaacccuucucuguuccuauccugaccguggaggaaaugacaaacuccagauuucccauuccgcuugagaagcuguucaccgggccuagcucugccuucgucgugcagccccagaacggacgguguacaaccgauggcguucuccuggggacgacacaacuguccccugugaauaucugcagcuuucgcggagacgucacccauaucgccggcuccagaaacuacacaaugaaucucgcuucucagaacuggaauagcuaugaucccaccgaggaaauuccugcgccccugggcaccccggacuucguggggaaaauccagggaguccuuacacagacgacccggacagacggcuccacccgcgggcacagagccacaguguacaccggaagcgcugauuuuucuccuaagcugggccggguucaauucgccacggacacagauaacgacuuuguggccaaucagaacaccaaguucacccccgucggggugauucaggauggagacacagcucaucgcaaugagccccaacaguggguucucccuuccuacagcggcagaaacauccacaaugugcaccuggccccggcggucgcucccaccuuuccuggcgaacagcuucuguucuuucggucuacaaugcccggguguagcggauauccuaacauggaucucgacugccugcugccccaggagugggugcaacauuucuaccaggaagccgccccugcucaguccgauguggcccuccugagauuuguuaaucccgacacgggccgcguccuuuucgaguguaaacugcacaagucuggguaugugaccguggcucauacaggacagcacgaucucgucauuccgccuaacggcuacuuucgguucgacagcugggugaaucaauucuauacccuggcccccauggggaacggcacaggaagacgccgguga

SEQ ID NO: 29167 - RNA, 1617 nt, Artificial Sequence
  derived and/or modified sequence opt5 from VP1__Norovirus_and/or_Norovirus-like__KR131769
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccaucgucgugcagccccagaauggacgcuguaccacggauggcguucuccuggggacaacccaacugucugccgugaacaucugcacauucagaggagacgucacccauauugcuggcucccggaauuauaccaugaaccucgcgagccagaauuggaacaauuacgauccuacagaggaaauccccgccccucugggcacgcccgacuucguggggaagauucagggaaugcuuacccagacaacccgcucugacggcuccacaagagggcacaaagcuaccguccugacgggaagcgccgauuuugccccgaagcucggccgggugcaauucgcuacagacaccgauaacgacuuugaguccgggcagaauaccaaguucacaccuguuggagugauccaggauggcucuaccacacaucgcaacgaaccccaacaguggguccugcccaauuacagcggcagaacggggcacaacgugcaccuugccccugcgguugcuccgaccuaucccggagagcagcugcucuuuuuccgguccacaaugccuggcuguagcggguaccccaauauggaccuggauugccugcucccucaggaaugggugcaacauuuuuaucaggaggccgcccccgcucagucugacgucgcccugcuuagauucgugaacccugauaccggacgcgugcuguuugaguguaaacuccacaaguccggcuacguuacagucgcucauaccgggcagcacgaccuggugauucccccgaacggcuauuuccgguuugauagcugggugaaucaauucuacacgcuugccccuaugggaaacggcaccgggagacgccgguga

SEQ ID NO: 29168 - RNA, 1617 nt, Artificial Sequence
  derived and/or modified sequence opt5 from VP1__Norovirus_and/or_Norovirus-like__KR131764
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuuccagccggaauuauaccaugaaccucgcgucucagaauuggaacaauuacgauccuacagaggaaauucccgccccucugggcacgcccgacuuugugggcaagauccaggggaugcuuacccagacaaccaaauccgacggaagcacacgcggccacaaggcuaccguccugacgggguccgccgauuucgccccgaagcucggaagagugcaauuugcuacagacaccgauaacgacuucgagucuggccagaauaccaaauuuacaccuguuggggugauucaggauggaagcaccacacaucggaacgaaccccaacaguggguccugcccaauuacuccggccgcacgggccacaacgugcaccuugccccugcgguugcuccgaccuaucccggggagcagcuccuguucuuuagaagcacaaugccuggauguucuggcuaccccaauauggaccuggauugccugcucccucaggaaugggugcaacauuucuaucaggaggccgcccccgcucaguccgacgucgcccugcuucgguuugugaacccugauaccgggagagugcuguucgaguguaagcuccacaaaagcggauacguuacagucgcucauaccggccagcacgaccuggugauucccccgaacggguauuuucgcuucgauucuugggugaaucaauuuuacacgcuugccccuaugggcaacggaaccggccggagacgcuga

SEQ ID NO: 29169 - RNA, 1617 nt, Artificial Sequence
  derived and/or modified sequence opt5 from VP1__Norovirus_and/or_Norovirus-like__GU390901
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucaccggcagcagaaacuacacaaugaaucucgccacgcagaacuggaacucuuaugaucccaccgaggaaauuccugcuccccugggcacaccggacuucguggggaaaauccagggaguccuuacccagacaacccgggcggacggcuccacgcgcgggcacaaggccacaguguacaccggaagcgcugauuuuuccccuaagcugggcagaguucaauucgccaccgacacagauaaugacuuugaugccaaucagaacaccaaauucacacccgugggggucauucaggacggagauacggcucaucggaaugagccccaacagugggugcucccuucuuacagcggccgcaacucccacaauguucaccuggccccggcgguggcucccaccuuuccuggcgaacagcuucuguucuuuagaagcacaaugcccggguguucuggauauccuaacauggaccucgauugccugcugccccaggaguggguccaauacuucuaucaggaagccgccccugcucaguccgacguggcccuccugcgguuugugaaucccgauaccggcagaguucuuuucgaguguaagcugcauaaaagcggguacgucacaguggcucacaccggacagcaugaccucgugaucccgccuaacggcuauuuucgcuucgacucuugggucaaccaauucuacacgcuggcccccauggggaauggcaccggacggagacgcuga

SEQ ID NO: 29170 - RNA, 1617 nt, Artificial Sequence
  derived and/or modified sequence opt5 from VP1__Norovirus_and/or_Norovirus-like__EU078408
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgagacccuucaccguuccuauccugacaguggaggaaaugaccaauucccgguuucccauuccgcuugagaaacuguucacagggccuagcggagccuucgucgugcagccccagaacggccgcuguaccacggaugggguucuccugggaacaacccaacugucuccugugaauaucugcacauuuagaggcgacgucacccauaucgccggcacccacgauuacacaaugaaccucgcuucccagaauuggaacaauuaugaccccacggaggaaauuccugcgccccuggggaccccggacuucgugggaaagauccagggcguccuuagccagacaacccgcggggauggaucuacacggggccauaaagccaccguguccacggggagcguucacuuuacaccuaagcugggauccgugcaauucaccaccgacacaaacaaugaucucgagaccggccagaacacaaaguuuacgcccgucggcgugguucaggacggaaauucuacccaccaaaacgaaccccagcagugggugcugccuaauuacagcgggagaacaggccauaacguccaccuugcuccggccguggcccccaccuucccuggggagcagcugcucuuuuuccgguccacaaugcccggauguagcggcuacccuaauaugaaccuggauugccugcucccccaagaaugggugcagcauuuuuaucaggaggcugccccugcgcagucugacguugcucugcuucgcuucgucaaccccgauaccgggagagugcuguuugaguguaaacuccacaaguccggcuacgugacggucgcccacaccggacaacaugaccuggugauuccgccuaauggcuauuuccgguuugauagcuggguuaaccaguucuacacacuugcccccauggggaauggagcuggcagacgccgguga

SEQ ID NO: 29171 - RNA, 1617 nt, Artificial Sequence
  derived and/or modified sequence opt5 from VP1__Norovirus_and/or_Norovirus-like__AB933676
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugagcaucugcaccuuucgcggagacgucacacauaucgcuggcucuagagauuacaccaugaaccucgcgucccugaauuggaacaauuaugacccuaccgaggaaauucccgccccucuuggcacacccgacuucguggggaaaauccagggaguccugacgcagaccacaaagggcgaugggagcacccggggacacaaggcuacaguguacaccggcuccgccccguuuacgccuaaacucgggucuguucaguucagcacagacaccgagaacgauuuugaaacccaucaaaauacaaaguucacccccgugggagucauucaggacggcuccacagcccaccgcaacgagccccagcaaugggugcugccuagcuacucuggcagaaauguucagaacgugcaccuugcuccggccgucgcgcccacguuuccuggggaacagcuccuguucuuucgguccaccaugcccggauguagcggcuauccuaauauggaucuggacugccugcucccccaggagugggugcaacauuucuaccaggaggcugccccugcccagucugauguggcucugcuucgcuuuguuaaccccgacacagggagaguccuguucgaauguaaacuccacaagagcggauaugugaccguggcccauacaggccagcacgaucuggucaucccgccuaauggguacuuucgguucgacuccugggugaaccaauucuauacccuugcucccaugggcaacggaacgggcagacgccgguga

SEQ ID NO: 29172 - RNA, 1617 nt, Artificial Sequence
  derived and/or modified sequence opt5 from VP1__Norovirus_and/or_Norovirus-like__KX354082
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucaucguggacgugagacaacucgagccuguccugauuccccugccugauguucggaacaauuuuuaucacuacaaccagagcaaugacuccacaaucaagcucauugccaugcuguauacaccccuucgcgcuaacaacgccggcgaugacguguucaccgugagcugcagaguccugacccggcccucuccugauuuugacuucaucuuucucgugccgcccacaguugaaucccgcaccaaaccuuucacggugcccauucugaccgucgaggaaaugacaaauagcagauuuccuaucccccuugagaagcuguucaccgggccgucuuccgccuucgugguucagccucagaacggacgguguacaaccgauggcgugcuccuggggacgacacaacugagccccgucaauauuugcaccuuucgcggagacgugacacauaucgcuggcucuagaaacuacaccaugaaucucgcgucccugaacuggaauaacuaugauccuaccgaggaaauccccgccccucuuggcacacccgacuucgucgggaaaauucagggagugcugacgcagaccacaaagcgggacggcagcacccgcgggcacaaggcuacaguuuacaccggauccgccgauuuuacgccgaaacucggcucugugcaguucgggacagacaccgagaaugauuuugaaacccaucaaaacacaagauucaccccugucggagugauccaggacggcagcacaacgcaccggaaugagccccagcaauggguucugcccuccuacagcggccgcaacgugcacaauguccaucuugccccugcuguggccccgaacuuucccggggaacagcuccuguucuuuagaucuaccaugccuggauguuccggcuaucccaauauggaucuggacugccugcucccucaggagugggugcagcacuucuaccaagaggcggcucccgcccagagcgauguugcccugcuucgguuugucaacccugacacagggagagugcuguucgaauguaagcuccauaaaucuggauaugugaccgucgcucacacaggccagcacgaucuggugauucccccgaacggguacuuucgcuucgacagcuggguuaaucaguucuauacccuugccccuaugggcaacggaacgggccggagacgcuga

SEQ ID NO: 29173 - RNA, 1617 nt, Artificial Sequence
  derived and/or modified sequence opt5 from VP1__Norovirus_and/or_Norovirus-like__KJ407076
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugagcaauucuagauuuccuauuccccuugagaagcuguacaccgggccguccagcgccuucgucgugcagccucagaacggacgguguacaaccgauggcguucuccuggggacgacacaacugucugccgugaauaucugcaccuuccgcggagacgucacacauaucgcuggcucccacgauuauaccaugaaccucgcgagccagaauuggaacaauuacgaccccaccgaggaaauuccugcuccccugggcacaccugacuuuguggggaaaauccagggaaugcuuacgcagaccacaagagaggauggcuccacccgggcccauaaggccacagucucuaccgggagcgugcacuucacgcccaagcugggauccguucaauacacaaccgacaccaacaaugauuuucagacaggccagaacaccaaauucacaccggugggggucauucaagacggaaauaaccaccagaaugaaccucagcagugggugcuccccaacuauagcggccgcacgggccauaauguucaccuggcccccgcuguggccccuaccuuuccgggggagcaacuucuguucuuuagaucuacaaugcccggauguuccggcuacccuaacaugaaccucgauugccugcugccccaggaauggguccagcauuucuaucaggaggcggcuccugcccaaagcgacguggcccuccugcgguuugugaaucccgauaccgggcgcguucuuuucgaguguaagcugcacaaaucuggauacgucacaguggcucacaccggcccucaugaccucgugauucccccgaacggguauuuuagauucgauagcugggucaaucaguuuuacacgcuggccccuaugggcaacggagcuggccggagacgcguguga

SEQ ID NO: 29174 - RNA, 1617 nt, Artificial Sequence
  derived and/or modified sequence opt5 from VP1__Norovirus_and/or_Norovirus-like__JX459636
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagagacuacaccaugaaccucgcgucccugaauuggaacaauuaugauccuaccgaagagauucccgccccucuuggcacacccgacuucguggggaaaauccagggaguccugacgcagaccacaaagggcgacgggagcacccggggacacaaggcuacaguguacaccggcuccgccccguuuacgccuaaacucgggucuguucaguucagcacagauaccgaaaacgacuuugagacccaucaaaauacaaaguucacccccgugggagucauucaggauggcuccacaacgcaccgcaacgaaccccagcaaugggugcugccuagcuacucuggcagaaauguucagaacgugcaccuugccccggcugucgcccccaccuuuccuggggagcagcuccuguucuuucgguccacaaugcccggauguagcggcuauccuaauauggaccuggauugccugcucccccaggagugggugcaacauuucuaccaggaagcggcuccugcccagucugacguggcccugcuucgcuuuguuaaccccgauaccgggagaguccuguucgaguguaaacuccacaagagcggauaugugacaguggcucauaccggccagcacgaccuggucaucccgccuaauggguacuuucgguucgauuccugggugaaccaauucuauacgcuugcccccaugggcaacggaaccggcagacgccgguga

SEQ ID NO: 29175 - RNA, 1617 nt, Artificial Sequence
  derived and/or modified sequence opt5 from VP1__Norovirus_and/or_Norovirus-like__JX445161
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucaccggcagcagaaacuacacaaugaaucucgccacgcagaacuggaacucuuaugaucccaccgaggaaauuccugcuccccugggcacaccggacuucguggggaaaauccagggaguccuuacccagacaacccgggcggacggcuccacgcgcgggcacaaggccacaguguacaccggaagcgcugauuuugccccuaagcugggcagaguucaauucgccaccgacacagauaaugacuuugaugcuaaucagaacaccaaauucacacccgugggggucauucaggacggagauacggcccaucggaaugagccccaacagugggugcucccuuccuacucuggccgcaacagccacaauguucaccuggcgccggcuguggcccccaccuuuccuggcgaacagcuucuguucuuuagauccacaaugcccggguguagcggauauccuaacauggaccucgauugccugcugccccaggaguggguccaauacuucuaucaggaagccgcuccugcccagucugacguggcucuccugcgguuugugaaucccgauaccggcagaguucuuuucgaguguaagcugcauaaauccggguacgucacaguggcccacaccggacagcaugaccucgugaucccgccuaacggcuauuuucgcuucgacagcugggucaaccaauucuacacgcuggcgcccauggggaauggcaccggacggagacgcuga

SEQ ID NO: 29176 - RNA, 1617 nt, Artificial Sequence
  derived and/or modified sequence opt5 from VP1__Norovirus_and/or_Norovirus-like__EU876888
augaagauggccagcuccgacgcuucucccagcgauggcuccgccgcgaaccuggugccugaggucaauaacgaaguuauggcucucgagccgguggugggggccgccaucgcugcccccgucgcuggacagcaaaauaucaucgacccuuggauuagaaacaauuucgugcaggcccccggcggggaauuuaccguuucuccucggaacgcgcccggagagauccuguggagcgccccucuuggcccggaucugaaucccuaccucucccaccugucucgcauguauaacggguacgcuggaggcuucgaagugcaggucauucuugccggcaaugcuuuuacagccgggaaagugaucuucgcggccguuccucccaacuuuccuacggagggacugagccccucccaggugaccauguucccgcauaucauugucgacgugagacaacucgagccugugcugaucccccugccugauguccggaauaacuuuuaucacuacaaucagacaaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucaccguuccuauccugacaguggaggaaaugaccaacagcagauuucccauuccgcuugagcggcuguacacagggccuucuuccgccuucgucgugcagccccagaauggacgcuguaccacggauggcguucuccuggggacaacccaacugagcgccgugaacaucugcacauucagaggagacgucacccauaucgcuggcucucggaauuauaccaugaaccucgcgucccagaauuggaacaauuacgauccuacagaggaaauucccgccccucugggcacgcccgacuuuguggggaagauccagggaaugcuuacccagacaacccgcggcgacgggagcacaagaggacacaaagcuaccgucuacacgggcuccgccgauuucgccccgaagcuggggcgggugcaauuugcuacagacaccgauaacgacuucgagucuaaucagaacaccaaguuuacaccuguuggagugauucaggauggcaauaccacacaucgcaacgaaccccaacaguggguccuccccggcuauagcgggagagacggacacaaugugcaccuggccccugcgguugcuccgacguaccccggcgagcagcuucuguucuuucgguccaccaugccuggguguagcggauaucccaacauggaucucgacugccugcugccucaggaaugggugcaacauuucuaccaggaggccgcccccgcucagucugaggucgcccuccugagauuugugaauccugauacaggccgcgugcuuuucgaauguaaacugcacaaguccggguauguuaccgucgcucauacaggccagcacgaccucgugauucccccgaacggauacuuucgguucgauagcugggugaaccaauuuuauacccuggccccuaugggcaauggggcgggaagacgccgguga

SEQ ID NO: 29177 - RNA, 1617 nt, Artificial Sequence
  derived and/or modified sequence opt5 from VP1__Norovirus_and/or_Norovirus-like__EU839584
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaaagagagacggcucuacccgggggcacaaggccacgguguccacaggaagcguucauuuuaccccuaaacugggcuccgugcaguucucuaccgauacaagcaaugacuuugagauugggcagaacacccgcuucacacccgucggagugguucaagauggcuccacgacccaccagaaugaaccccagcagugggugcucccuaacuacagcggcagagacgggcacaauguccaucuggcuccggccguggcccccacauuuccuggagagcaacuucuguucuuucggucuaccaugcccggcuguuccggguacccuaacaugaaucucgauugccugcugccccaggaaugggugcagcacuucuaucaggagagcgcuccugcccaaucugacguugcgcuccugcgcuuugucaaccccgauacaggcagagcucuuuucgaguguaagcugcauaaaagcggauacgugaccguggcccacacggggcagcacgaccucgucaucccgccuaacggcuauuuucgguucgauuccugggugaaucaguucuacacccuggcccccaugggaaacggcgcugggagacgccgguga

SEQ ID NO: 29178 - RNA, 1617 nt, Artificial Sequence
  derived and/or modified sequence opt5 from VP1__Norovirus_and/or_Norovirus-like__KX354090
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucacgguucccauccugaccguggaggaaaugacaaauagcagauuuccuauuccccuugagaagcuguucaccgggccgucuuccgccuucgucgugcagccucagaacggacgguguacaaccgauggcguucuccuggggacgacacaacugagccccgugaauaucugcaccuuucgcggagacgucacacauaucgcuggcucuagaaacuacaccaugaaucucgcgucccugaacuggaauaacuaugauccuaccgaggaaauucccgccccucuuggcacacccgacuucguggggaaaauccagggaguccugacgcagaccacaaagggcgacgggagcacccggggacacaaggcuacaguguacaccggcuccgccgauuuuacgccgaaacucgggucuguucaguucggaacagacaccgagaaugauuuugaaacccaucaaaacacacgcuucaccccugugggcgucauucaggacggcagcacaacgcacagaaaugagccccagcaaugggugcugcccuccuacagcgggcggaacguucacaaugugcaucuugccccugcugucgccccgaacuuucccggagaacagcuccuguucuuucgcucuaccaugccuggcuguuccggguaucccaauauggaucuggacugccugcucccucaggagugggugcagcacuucuaccaagaggcggcucccgcccagagcgauguggcccugcuuagauuuguuaacccugacacaggacggguccuguucgaauguaagcuccauaaaucuggcuaugugaccguggcucacacagggcagcacgaucuggucauucccccgaacggcuacuuuagauucgacagcugggugaaucaguucuauacccuugccccuaugggaaacggcacggggcgccggagauga

SEQ ID NO: 29179 - RNA, 1617 nt, Artificial Sequence
  derived and/or modified sequence opt5 from VP1__Norovirus_and/or_Norovirus-like__KF060124
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccugugcugacggucgaggaaaugaccaauagcagauuucccgugccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucucacaacuacaccaugaaucucgcuucccagaacuggaauagcuaugaucccaccgaggaaaucccugcgccccugggcacaccggacuucguggggaaaauccagggaguucuuacgcagaccacaagagccgacggcuccacccgggggcauaaggcuacaguguacaccggaucugccgauuuugccccuaagcugggccgcguccaauucgcuacggacacaaacaaugauuuugacgccaaccagaauaccaaauucacccccguggggguuauucaggauggagacacagcgcacagaaacgagccccaacagugggugcucccuagcuacuccggccggaauagccacaacguccaucuggcuccggccguggcccccaccuuuccuggcgaacagcuucuguucuuucgcucuacaaugcccggguguuccggauauccuaauauggaucucgacugccugcugccccaggagugggugcaauacuucuaucaggaagcugccccugcucagagcgauguugcccuccugagauuugucaaccccgacacgggccgggugcuuuucgaguguaagcugcacaaaucuggguacgugaccgucgcgcauacaggacagcacgaucucgugaucccgccuaacggcuauuuuagauucgacagcuggguuaaucaauucuacacccuggcccccauggggaacggcacaggacgccggagauga

SEQ ID NO: 29180 - RNA, 1617 nt, Artificial Sequence
  derived and/or modified sequence opt5 from VP1__Norovirus_and/or_Norovirus-like__JX439826
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccuauccugacgguggaggaaaugaccaauagcagauuucccauuccgcuugagaagcuguucacagggccuucuuccgccuucgucgugcagccccagaacggacgguguaccacagauggcguucuccuggggaccacgcaacugagcccugugaauaucugcacauuucgcggagacgucacccauaucacaggcucuagaaacuacaccaugaaucucgcuacccagaacuggaacuccuaugaucccacagaggaaauuccugcgccccugggcacgccggacuucguggggaaaauccagggaguccuuacccagacaacccgggccgacggcagcacacgcgggcacaaggcuaccguguacacgggauccgccgauuuugccccuaagcugggcagaguucaauucgcuacagacaccgauaaugacuuugaugccaaucagaacaccaaauucacacccgugggggucauucaggacggagauaccgcgcaucggaaugagccccaacagugggugcucccuucuuacagcggccgcaacucccacaauguucaccuggcuccggccguggcccccacauuuccuggcgaacagcuucuguucuuuagaagcacgaugcccggguguucuggauauccuaacauggaccucgauugccugcugccccaggaguggguccaauacuucuaucaggaagcugccccugcucaguccgacguggcccuccugcgguuugugaaucccgauaccggcagaguucuuuucgaguguaagcugcauaaaagcggguacgucacaguggcgcacaccggacagcaugaccucgugaucccgccuaacggcuauuuucgcuucgacucuugggucaaccaauucuacacacuggcccccauggggaauggcaccggacggagacgcuga

SEQ ID NO: 29181 - RNA, 1617 nt, Artificial Sequence
  derived and/or modified sequence opt5 from VP1__Norovirus_and/or_Norovirus-like__JX439815
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccuauccugaccguggaggaaaugacaaacuccagauuucccauuccgcuugagaagcuguucaccgggccuagcucugccuucgucgugcagccccagaauggacgguguacaaccgauggcguucuccuggggacgacacaacuguccccugugaacaucugcaccuuucgcggagacgucacacauaucaccggcagcagaaauuacaccaugaaccucgccacacagaauuggaacucuuaugaucccacggaggaaauuccugcuccccugggcaccccggacuucguggggaaaauccagggaguccuuacacagaccacacgggcggacggcuccacccgcgggcacaaggccacgguguacacaggaagcgcugauuuugccccuaagcugggcagaguucaauucgccaccgacaccgauaaugacuuugaugcuaaccagaauacaaaauucacccccgugggggucauucaggacggagauacagcccaucggaacgagccccaacagugggugcucccuuccuacucuggccgcaauagccacaacguucaccuggcgccggcuguggcccccacguuuccuggcgaacagcuucuguucuuuagauccaccaugcccggguguagcggauauccuaauauggaccucgauugccugcugccccaggaguggguccaauacuucuaucaggaagccgcuccugcccagucugacguggcucuccugcgguuugugaaccccgauacaggcagaguucuuuucgaguguaagcugcauaaauccggguacgucaccguggcccacacaggacagcaugaccucgugaucccgccuaacggcuauuuucgcuucgacagcugggucaaucaauucuacacccuggcgcccauggggaacggcacgggacggagacgcuga

SEQ ID NO: 29182 - RNA, 1617 nt, Artificial Sequence
  derived and/or modified sequence opt5 from VP1__Norovirus_and/or_Norovirus-like__KC576912
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccagaugauccuugcuggcaacgccuuuacagcggggaaaauuaucuucgccgcugugccucccaauuuuccuacggagggacugucccccucucagguuaccauguucccgcauaucauuguggacgucagacaacucgagccugugcugaucccccugccugaugugcggaacaauuuuuaucacuacaaccagagcaaugaccccacaauuaagcucaucgccaugcuguauacaccccuucgcgcuaacaacgccggcgaugacgucuucaccguuuccugcagagugcugacccggccuagcccggauuuugacuucauuuuucucgugcccccuacagucgaaucucgcaccaaacccuucacggugccuguucugaccguggaggaaaugacaaauuccagauuucccaucccgcuugagaagcuguucaccgggccuagcucugccuucgucgugcagccccagaacggacgguguacaaccgauggcguucuccuggggacgacacaacuguccccugugaauauuugcaccuuucgcggagacgucacacauaucgcuggcagcagaaacuacaccaugaaucucgcgucucugaacuggaauaacuaugaucccaccgaggaaaucccugcuccccuuggcacaccggacuucguggggaaaauucagggaguccugacgcagaccacaaagggcgacggguccacccggggacacaaggccacaguguacaccggcagcgccgauuuuacgccuaaacucggguccguucaguucggaacagacaccgauaaugacuuugagacccaucaaaacacacgcuucacccccgugggcgucauccaggauggcgccacaacgcacagaaaugaaccccagcaaugggugcugccuucuuacagcgggcggaacguucacaaugugcaucuugcuccggccgucgcgcccaacuuuccuggagagcagcuccuguucuuucgcuccaccaugcccggcuguagcggguauccuaauauggaccuggauugccugcucccccaggaaugggugcagcacuucuaccaagaggcugccccugcccagucugacguggcucugcuuagauuuguuaaccccgauacaggacggguccuguucgaguguaagcuccauaaauccggcuaugugaccguggcccacacagggcagcacgaccuggucauuccgccuaacggcuacuuuagauucgauagcugggugaaucaguucuauacccuugcucccaugggaaacggcacggggcgccggagauga

SEQ ID NO: 29183 - RNA, 1617 nt, Artificial Sequence
  derived and/or modified sequence opt5 from VP1__Norovirus_and/or_Norovirus-like__GQ845368
augaagauggccagcuccgacgcuucucccagcgauggcuccgccgcgaaccuggugccugaggucaauaacgaaguuauggcucucgagccgguggugggggccgccaucgcugcccccgucgcuggacagcaaaauaucaucgacccuuggauuagaaacaauuucgugcaggcccccggcggggaauuuaccguuucuccucggaacgcgcccggagagauccuguggagcgccccucuuggcccggaucugaaucccuaccucucccaccugucucgcauguauaacggguacgcuggaggcuucgaagugcaggucauucuugccggcaaugcuuuuacagccgggaaagugaucuucgcggccguuccucccaacuuuccuacggagggacugagccccucccaggugaccauguucccgcauaucauugucgacgugagacaacucgagccugugcugaucccccugccugauguccggaauaacuuuuaucacuacaaucagacaaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucaccguuccuauccugacaguggaggaaaugaccaacagcagauuucccauuccgcuugagcggcuguacacagggccuucuuccgccuucgucgugcagccccagaauggacgcuguaccacggauggcguucuccuggggacaacccaacugagcgccgugaacaucugcacauucagaggagacgucacccauaucaccggcucucggaauuauacaaugaaccucgcuucccagaauuggaacaauuacgauccuacggaggaaauucccgcgccucugggcacccccgacuuuguggggaagauccagggaaugcuuacacagaccacacgcggcgacgggagcaccagaggacacaaagccacggucuacacaggcuccgcugauuucgccccgaagcuggggcgggugcaauuugccaccgacaccgauaacgacuucgagucuaaucagaacacaaaguuuaccccuguuggagugauucaggauggcaauacaacgcaucaaaacgaaccccagcaguggguccuccccggcuauagcgggcgcgacggacacaaugugcaccuggcuccugccguugcgccgaccuaccccggcgagcagcuucuguucuuuagauccacaaugccuggguguagcggauaucccaacaugaaucucgauugccugcugccucaagaaugggugcagcauuucuaccaggaggcugcccccgcccagucugaggucgcucuccugcgguuugugaacccugacaccggcagagugcuuuucgaauguaaacugcacaaguccggguauguuacagucgcccauaccggccaacacgaucucgugauucccccgaacggauacuuucgcuucgacagcugggugaaucaguuuuauacgcuggcuccuaugggcaacggggccggacggagacgcuga

SEQ ID NO: 29184 - RNA, 1617 nt, Artificial Sequence
  derived and/or modified sequence opt5 from VP1__Norovirus_and/or_Norovirus-like__AB541249
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagagacuacaccaugaaucucgcgagccugaacuggaauaacuaugauccuacagaagagauucccgccccucuugggacgcccgacuucgugggaaaaauccaaggcguccugacccagacaaccaagggggacggaucuacacggggccacaaggcuaccguguacacgggguccgccccguuuacaccuaaacucggaagcguucaguucuccaccgauaccgaaaaugacuuugaggcccaucagaacacaaaguucacccccgugggcgucauucaagauggcucuacaacgcaccgcaaugaaccccagcagugggugcugccuagcuacuccgggagaaacguucaaaaugugcaccuugcuccggccgucgcgcccaccuuuccuggagagcagcuccuguucuuucggagcacaaugcccggcuguucuggguauccuaacauggaccuggauugccugcucccccaggagugggugcagcauuucuaccaagaagcugccccugcccaguccgacguggcucugcuucgcuuuguuaaucccgauaccggaagaguccuguucgaguguaaacuccacaagagcggcuaugugacaguggcccauaccgggcagcacgaccuggucaucccgccuaacggcuacuuucgguucgauucuugggugaaccaguucuauacgcuugcucccaugggaaauggcaccgggagacgccgguga

SEQ ID NO: 29185 - RNA, 1617 nt, Artificial Sequence
  derived and/or modified sequence opt5 from VP1__Norovirus_and/or_Norovirus-like__EU078412
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucagcucaacgaccccaccauuaagcugaucgcuaugcuuuauacaccccugcgcgccaauaacgcuggcgaugacguuuucaccguguccugcagagugcucacacggccuagcccggauuuugacuucauuuuucuggugcccccuaccgucgaaucucgcacgaaacccuucaccguuccuauccuuacaguggaggaaaugaccaacuccagauuucccauuccgcuggagaaacucuucacagggccuagcggagccuucgucgugcagccccagaauggccgguguaccacggaugggguucugcugggaacaacccaacucucuccugugaacaucugcacauuucgcggcgacgucacccauaucgccggcacccacgauuacacaaugaaucuggcuucccagaacuggaauaacuaugaccccacggaggaaauuccugcgccccuugggaccccggacuucgugggaaagauccagggcguccugacacagaccacaagaggggauggaagcacccggggccauaaggccacggugucuacaggguccguucacuuuaccccuaagcucggaagcgugcaauucaccacagacaccaauaacgaucuggagacaggccagaauacgcgcuuuacccccgucggcgugguucaggacgggaacuccacacaccaaaaugaaccccagcagugggugcuuccuaacuacucuggcagagcuggacauaauguccaccuggccccggccguggcucccaccuucccuggggagcagcuccuguuuuuccggagcacaaugcccggauguuccggcuacccuaacaugaaucuggauugccuccugccccaagaaugggugcagcauuuuuaucaggaggccgcgccugcucagagcgacguugcccuucugcgcuucgucaaccccgauaccgggagagugcucuuugaguguaaacugcacaagucuggcuacgugacggucgcccacaccggacaacaugaccuugugauuccgccuaacggcuauuuccgguuugauuccuggguuaaucaguucuacacacuggcucccauggggaacggagccggcagacgccgguga

SEQ ID NO: 29186 - RNA, 1617 nt, Artificial Sequence
  derived and/or modified sequence opt5 from VP1__Norovirus_and/or_Norovirus-like__AB445395
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggagauacagcccaucggaaugagccccaacagugggugcucccuucuuacagcggccgcaacaaucacaacguucaccuggcgccggcuguggcccccacguuuccuggcgaacagcuucuguucuuuagauccaccaugcccggguguagcggauauccuaauauggaccucgauugccugcugccccaggaguggguccaauacuucuaucaggaagccgcuccugcccagucugacguggcucuccugcgguuugugaaccccgauacaggcagaguucuuuucgaguguaagcugcauaaauccggguacgucaccguggcccacacaggacagcaugaccucgugaucccgccuaacggcuauuuucgcuucgacagcugggucaaucaauucuacacccuggcgcccauggggaacggcacgggacggagacgcuga

SEQ ID NO: 29187 - RNA, 1617 nt, Artificial Sequence
  derived and/or modified sequence opt5 from VP1__Norovirus_and/or_Norovirus-like__AB933655
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucggaacagacaccgagaacgauuuugaaacccaucaaaauacaaaguucaccccugugggcgucauucaggacggcucuacaacgcaccgcaacgagccccagcaaugggugcugcccagcuacuccgggagaaauguucacaacgugcaucuugccccugcugucgccccgaauuuucccggagaacagcuccuguucuuucggagcaccaugccuggcuguucuggguaucccaacauggaucuggacugccugcucccucaggagugggugcagcacuucuaccaagaggcggcucccgcccaguccgauguggcccugcuucgcuuuguuaacccugacacaggaagaguccuguucgaauguaaacuccauaagagcggcuaugugaccguggcucacacagggcagcacgaucuggucauucccccgaauggcuacuuucgguucgacucuugggugaaccaguucuauacccuugccccuaugggaaauggcacggggagacgccgguga

SEQ ID NO: 29188 - RNA, 1617 nt, Artificial Sequence
  derived and/or modified sequence opt5 from VP1__Norovirus_and/or_Norovirus-like__KM245072
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaacucuagauuucccauuccgcuugagaagcuguucaccgggccuuccagcgccuucgucgugcagccccagaauggacgguguacaaccgauggcguucuccuggggacgacacaacugucuccugugaacaucugcaccuuucgcggagacgucacacauaucaccggcuccagaaauuacaccaugaaccucgccacacagaauuggaacagcuaugaucccacggaggaaauuccugcuccccugggcaccccggacuucguggggaaaauccagggaguccuuacacagaccacacgggcggacggcuccacccgcgggcacaaggccacgguguacacaggaucugcugauuuugccccuaagcugggcagaguucaauucgccaccgacaccgauaaugacuuugaugcuaaccagaauacaaaauucacccccgugggggucauucaggacggagauacagcccaucggaacgagccccaacagugggugcucccuagcuacuccggccgcaauagccacaacguucaccuggcgccggcuguggcccccacguuuccuggcgaacagcuucuguucuuuagaucuaccaugcccggguguuccggauauccuaauauggaccucgauugccugcugccccaggaguggguccaauacuucuaucaggaagccgcuccugcccagagcgacguggcucuccugcgguuugugaaccccgauacaggcagaguucuuuucgaguguaagcugcauaaaucuggguacgucaccguggcccacacaggacagcaugaccucgugaucccgccuaauggcuauuuucgcuucgacagcugggucaaccaauucuacacccuggcgcccauggggaacggcacgggacggagacgcuga

SEQ ID NO: 29189 - RNA, 1617 nt, Artificial Sequence
  derived and/or modified sequence opt5 from VP1__Norovirus_and/or_Norovirus-like__AB541282
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaugacguuuucaccguguccugcagagugcugacacggcccagcccugauuuugacuucauuuuucucgucccgcccaccguggaaucucgcacgaaaccuuucaccguucccauccugacaguggaggaaaugaccaacuccagauuuccuauuccccuugagaagcuguucacagggccgagcggagccuucgucgugcagccucagaauggccgguguaccacggaugggguucuccugggaacaacccagcugucucccgugaacaucugcacauuucgcggcgacgucacccauaucgcuggcuccagaaauuacaccaugaaccucgcgagccugaauuggaacaauuaugauccuacagaggaaauucccgccccucuugggacgcccgacuucgugggaaaaauccaaggcguccugacccagacaaccaagggggacggaucuacacggggccacaaggcuaccguguacacgggguccgccccguuuacaccuaaacucggaagcguucaguucuccaccgauaccgagaacgacuuugaagcccaucagaauacaaaguucacccccgugggcgucauucaagauggcucuacaacgcaccgcaacgagccccagcagugggugcugccuagcuacuccgggagaaauguucaaaacgugcaccuugcuccggccgucgcgcccaccuuuccuggagaacagcuccuguucuuucggagcacaaugcccggcuguucuggguauccuaauauggaccuggauugccugcucccccaggagugggugcagcauuucuaccaagaggcugccccugcccaguccgacguggcucugcuucgcuuuguuaaccccgauaccggaagaguccuguucgaauguaaacuccacaagagcggcuaugugacaguggcccauaccgggcagcacgaccuggucaucccgccuaacggcuacuuucgguucgauucuugggugaaucaguucuauacgcuugcucccaugggaaacggcaccgggagacgccgguga

SEQ ID NO: 29190 - RNA, 1617 nt, Artificial Sequence
  derived and/or modified sequence opt5 from VP1__Norovirus_and/or_Norovirus-like__AB541202
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugguucuugccggcaacgcuuuuacggccgggaaaaucauuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuauucugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucaccggcucuagaaacuacaccaugaaucucgccacacagaacuggaacuccuaugaucccacggaggaaaucccugcuccccugggcaccccggacuucgucgggaaaauucagggagugcuuacacagaccacacgggcggacggcagcacccgcgggcacaaggccacgguuuacacaggauccgcugauuuugccccuaagcugggcagagugcaauucgccaccgacaccgauaaugacuuugaugcuaaucagaacacaaaauucacccccgucggggugauccaggacggagauacagcccaucggaaugagccccaacaguggguucucccuucuuacagcggccgcaacaaucacaacgugcaccuggcgccggcugucgcccccacguuuccuggcgaacagcuucuguucuuuagauccaccaugcccggguguagcggauauccuaauauggaccucgauugccugcugccccaggagugggugcaauacuucuaucaggaagccgcuccugcccagucugacguggcucuccugcgguuuguuaaccccgauacaggcagaguccuuuucgaguguaagcugcauaaauccggguacgugaccguggcccacacaggacagcaugaccucgucauuccgccuaacggcuauuuucgcuucgacagcugggugaaucaauucuacacccuggcgcccauggggaacggcacgggacggagacgcuga

SEQ ID NO: 29191 - RNA, 1617 nt, Artificial Sequence
  derived and/or modified sequence opt5 from VP1__Norovirus_and/or_Norovirus-like__FJ514242
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgaccccacaauuaagcucaucgccaugcuguauacaccccuucgcgcuaacaaugccggcgaagauguuuucaccgugagcugcagagugcugacccggccuuccccggacuuugauuucauuuuucucgugcccccuacagucgagagccgcaccaaacccuucacgguuccuauccugaccguggaagagaugacaaacucuagauuucccauuccgcuugagaagcuguucaccgggccuuccagcgccuucgucgugcagccccagaauggacgguguacaaccgacggcguucuccuggggacgacacaacugucuccugugaacaucugcaccuuucgcggagaugucacacauaucgcuggcuccagaaauuacaccaugaaccucgcgagccugaauuggaacaauuaugaccccaccgaagaggugccugcuccccuuggcacaccggauuucgucgggaaaauucagggagugcugacgcagaccacaaagggcgacgggucuacccggggacacaaggccacaguuuacaccggcuccgccccuuuuacgcccaaacucgggagcgugcaguucuccacagacaccgaaaacgauuuugagacccaucaaaauacaaaguucacccccgucggagugauccaggacggcucuacaacgcaccgcaacgaaccucagcaauggguucugccgagcuacuccggcagaaaugugcagaacguccaccuugcccccgcuguggccccuaccuuucccggggagcagcuccuguucuuucggagcacaaugccuggauguucuggcuaucccaauauggaucuggacugccugcucccucaggagugggugcaacauuucuaccaggaagcggcucccgcccaguccgauguugcccugcuucgcuuugucaacccggacaccgggagagugcuguucgaguguaaacuccacaagagcggauaugugacagucgcucauaccggccagcacgaucuggugauuccucccaacggguacuuucgguucgacucuuggguuaaucaauucuauacgcuugccccuaugggcaacggaaccggcagacgccgguga

SEQ ID NO: 29192 - RNA, 1617 nt, Artificial Sequence
  derived and/or modified sequence opt5 from VP1__Norovirus_and/or_Norovirus-like__KX353976
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaguuauuuucgccgcugugccucccaacuuuccuacggagggacugagccccucccaggucaccauguucccgcauaucaucguggacgugagacaacucgagccuguccugauuccccugccugauauccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucggaacagacaccgauaacgacuuugagacccaucaaaauacaaaguucaccccugugggcgucauucaggauggcucuacaacgcaccgcaacgaaccccagcaaugggugcugcccagcuacuccgggagaaauguucagaacgugcaccuugccccugcugucgccccgaauuuucccggagagcagcuccuguucuuucggagcaccaugccuggcuguucuggguaucccaacauggaccuggauugccugcucccucaggaaugggugcaacauuucuaccaggaggcggcucccgcccaguccgacguggcccugcuucgcuuuguuaacccugauacaggaagaguccuguucgaguguaaacuccacaagagcggcuaugugaccguggcucauacagggcagcacgaccuggucauucccccgaauggcuacuuucgguucgauucuugggugaaccaauucuauacccuugccccuaugggaaauggcacggggagacgccgguga

SEQ ID NO: 29193 - RNA, 1617 nt, Artificial Sequence
  derived and/or modified sequence opt5 from VP1__Norovirus_and/or_Norovirus-like__KX353952
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucacgguucccauccugaccguggaggaaaugacaaauagcagauuuccuauuccccuugagaagcuguucaccgggccgucuuccgccuucgucgugcagccucagaacggacgguguacaaccgauggcguucuccuggggacgacacaacugagccccgugaaugucugcaccuuucgcggagacgugacacauaucgcuggcucuagaaacuacaccaugaaucucgcgucccugaacuggaauaacuaugauccuaccgaggaaauccccgccccucuuggcacacccgacuucgucgggaaaauucagggagugcugacgcagaccacaaagggcgacgggagcacccggggacacaaggcuacaguuuacaccggcuccgccgauuuuacgccgaaacucgggucugugcaguucggaacagacaccgagaaugauuuugaaacccaucaaaacacacgcuucaccccugucggcgugauccaggacggcagcacaacgcacagaaaugagccccagcaauggguucugcccuccuacagcgggcggaacgugcacaauguccaucuugccccugcuguggccccgaacuuucccggagaacagcuccuguucuuucgcucuaccaugccuggcuguuccggguaucccaauauggaucuggacugccugcucccucaggagugggugcagcacuucuaccaagaggcggcucccgcccagagcgauguugcccugcuuagauuugucaacccugacacaggacgggugcuguucgaauguaagcuccauaaaucuggcuaugugaccgucgcucacacagggcagcacgaucuggugauucccccgaacggcuacuuuagauucgacagcuggguuaaucaguucuauacccuugccccuaugggaaacggcacggggcgccggagauga

SEQ ID NO: 29194 - RNA, 1617 nt, Artificial Sequence
  derived and/or modified sequence opt5 from VP1__Norovirus_and/or_Norovirus-like__KR131771
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggaacaauuacgauccuacagaggaaauucccgccccucugggcacgcccgacuuuguggggaagauccagggaaugcuuacccagacaacccgcucugacggcuccacaagagggcacaaagcuaccguccugacgggaagcgccgauuucgccccgaagcucggccgggugcaauuugcuacagacaccgauaacgacuucgaguccgggcagaauaccaaguuuacaccuguuggagugauucaggauggcucuaccacacaucgcaacgaaccccaacaguggguccugcccaauuacagcggcagaacggggcacaacgugcaccuugccccugcgguugcuccgaccuaucccggagagcagcuccuguucuuucgguccacaaugccuggcuguagcggguaccccaauauggaccuggauugccugcucccucaggaaugggugcaacauuucuaucaggaggccgcccccgcucagucugacgucgcccugcuuagauuugugaacccugauaccggacgcgugcuguucgaguguaaacuccacaaguccggcuacguuacagucgcucauaccgggcagcacgaccuggugauucccccgaacggcuauuuucgguucgauagcugggugaaucaauuuuacacgcuugccccuaugggaaacggcaccgggagacgccgguga

SEQ ID NO: 29195 - RNA, 1617 nt, Artificial Sequence
  derived and/or modified sequence opt5 from VP1__Norovirus_and/or_Norovirus-like__AB933729
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccauuguguacacgggauccgcugauuuugccccuaagcugggcagaguucaauucgccacagacaccgauaaugacuuuggggcuaaucagaacaccaaauucacacccgugggagucauccaggauggcgacaccgcccaucggaaugagccccaacagugggugcucccuucuuacagcggccgcaacucccacaauguucaccuggcgccggcuguggcccccacauuuccuggggaacagcuucuguucuuuagaagcacgaugcccggauguucuggcuauccuaacauggaucucgacugccugcugccccaggaguggguccaauacuucuaucaggaagccgcuccugcccaguccgauguggcucuccugcgguuugugaaucccgacaccgggagaguucuuuucgaguguaagcugcauaaaagcggauacgucacaguggcccacaccggccagcaugaucucgugauuccgccuaacggguauuuucgcuucgacucuugggucaaccaauucuacacacuggcgcccaugggcaauggaaccggccggagacgcuga

SEQ ID NO: 29196 - RNA, 1617 nt, Artificial Sequence
  derived and/or modified sequence opt5 from VP1__Norovirus_and/or_Norovirus-like__AB933646
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagagacuacaccaugaaucucgcgucucugaacuggaauaacuaugauccuaccgaagagauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgaaaaugacuuugagacccaucaaaacacaaaguucacccccgugggagucauucaggauggcggcacaacgcaccgcaaugaaccccagcaaugggugcugccuagcuacuccgggagaaacguuccgaaugugcaccuugcccccgcugucgccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgagguggcccugcuucgcuuuguuaauccggacaccggaagaguccuguucgaauguaaacuccacaagagcggcuaugugacaguggcucauaccgggcagcacgaucuggucaucccucccaacggcuacuuucgguucgacucuugggugaaccaguucuauacgcuugccccuaugggaaauggcaccgggagacgccgguga

SEQ ID NO: 29197 - RNA, 1617 nt, Artificial Sequence
  derived and/or modified sequence opt5 from VP1__Norovirus_and/or_Norovirus-like__JX155742
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucggaacagacaccgaaaaugauuuugagacccaucaaaacacaaaguucacccccgugggcgucauucaggacggcgggacaacgcaccgcaaugaaccccagcaaugggugcugccuagcuacuccggaagaaacguuccgaaugugcaccuugcccccgcugucgccccuaccuuucccggcgagcagcuccuguucuuucggagcacaaugccuggguguucuggauaucccaacauggaucuggacugccugcucccucaggagugggugcagcauuucuaccaagaagcggcucccgcccaguccgauguggcccugcuucgcuuuguuaauccggacaccggcagaguccuguucgaguguaaacuccacaagagcggguaugugacaguggcucauaccggccagcacgaucuggucaucccucccaacggauacuuucgguucgacucuugggugaaccaguucuauacgcuugccccuaugggcaaugggaccggaagacgccgguga

SEQ ID NO: 29198 - RNA, 1617 nt, Artificial Sequence
  derived and/or modified sequence opt5 from VP1__Norovirus_and/or_Norovirus-like__JN400614
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccuccuuuacgccgaaacucgggucuguucaguucagcacagauaccgagaacgacuuugaaacccaucaaaauacaaaguucaccccugugggagucauucaggauggcuccacaacgcaccgcaacgagccccagcaaugggugcugcccagcuacucuggcagaaauguucacaacgugcaucuugccccugcugucgccccgaccuuucccggggaacagcuccuguucuuucgguccacaaugccuggauguagcggcuaucccaauauggaccuggauugccugcucccucaggagugggugcagcacuucuaccaagaggcggcucccgcccagucugacguggcccugcuucgcuuuguuaacccugauaccgggagaguccuguucgaauguaaacuccauaagagcggauaugugacaguggcucacaccggccagcacgaccuggucauucccccgaacggguacuuucgguucgauuccugggugaaucaguucuauacgcuugccccuaugggcaacggaaccggcagacgccgguga

SEQ ID NO: 29199 - RNA, 1617 nt, Artificial Sequence
  derived and/or modified sequence opt5 from VP1__Norovirus_and/or_Norovirus-like__JN400601
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagagacuacaccaugaaucucgcgagccugaacuggaauaacuaugauccuaccgaagagauucccgccccucuugggacacccgacuucgugggaaaaauccagggcguccugacgcagaccacaaaggggaauggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuauaucacaguggcucacaccgggcagcacgaucuggugauuccgccuaacggcuacuuucgguucgacucuugggucaaucaguucuauacgcuugcccccaugggaaacggcaccgggagacgccgguga

SEQ ID NO: 29200 - RNA, 1617 nt, Artificial Sequence
  derived and/or modified sequence opt5 from VP1__Norovirus_and/or_Norovirus-like__JQ613538
augaagauggccagcuccgacgcuaaccccucugauggcagcaccgccaaucuggugccugaggucaacaaugaaguuauggcgcucgagccgguggugggggcugccaucgccgcucccgucgccggacagcaaaacauuaucgacccuuggauuagaaauaacuucgugcaggcucccggcggggaauuuacaguuuccccucggaaugcccccggagagauccuguggucugcgccucuuggcccggaucugaaccccuaccucagccaccuggcccgcauguauaauggguacgcuggaggcuucgaagugcaggucauucuugccggcaacgcuuuuacggccgggaaaaucguguucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucucacaacuacaccaugaaucucgcuucccagaacuggaauagcuaugaucccaccgaggaaauuccugcgccccugggcacaccggacuucguggggaaaauccagggaguccuuacgcagaccacaagaaccgacggcuccacacgggggcauaaggccaccguguacacgggaucugcugaguuuagcccuaagcugggccgcauucaauucgccacagauaccaacaaugacuuugaugccaaccagaauaccaaauucacacccguuggggugauccaggacggaggcaccacacacagaaacgaaccccaacaguggguccucccuuccuacagcggccggaauacgcacaacgugcaucuggcuccggccguugcgcccaccuuuccuggggagcagcuucuguucuuucgcucuacacuccccggauguuccggcuauccuaauauggaucuggacugccugcucccccaggaaugggugcaauacuucuaucaggaggcugccccugcccagagcgaugucgcucugcuuagauuugugaaccccgacaccgggcgggugcuguucgaguguaagcuccacaaaucuggauacguuacagucgcccauaccggccagcacgaucuggugauuccgccuaacggguauuuuagauucgacagcugggugaaucaauucuacacgcuugcucccaugggcaacggaaccggccgccggagauga

SEQ ID NO: 29201 - RNA, 1617 nt, Artificial Sequence
  derived and/or modified sequence opt5 from VP1__Norovirus_and/or_Norovirus-like__HM802543
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaagauucacgcccgucggagugguucaagauggcgacaccacacaccagaaugaaccccagcagugggugcucccugauuacuccggccgggacagccacaacguccaucuggcuccggccguggcccccaccuuuccuggggagcaacuucuguucuuucgcucuacaaugcccggauguuccggcuacccuaauaugaaccucgauugccugcugccccaggaaugggugcagcacuucuaucaggagagcgcuccugcccaaucugacguugcgcuccugagauuugucaaucccgauaccgggcgggugcuuuucgaguguaaacugcauaagagcggauacgugacggucgcucacaccggccagcacgaccucgugauuccgccuaacggguauuuuagauucgauuccuggguuaaccaguucuacacacuggcccccaugggcaauggagccggccgccggagauga

SEQ ID NO: 29202 - RNA, 1617 nt, Artificial Sequence
  derived and/or modified sequence opt5 from VP1__Norovirus_and/or_Norovirus-like__AB541337
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagagacuacaccaugaaucucgcgagccugaacuggaauaacuaugauccuacagaagagauucccgccccucuugggacgcccgacuucgugggaaaaauccaaggcguccugacccagacaaccaagggggacggaucuacacggggccacaaggcuaccguguacacgggguccgccccguuuacaccuaaacucggaagcguucaguucuccaccgauaccgaaaaugacuuugagacacaucagaacaccaaguucacacccgugggcgucauucaagauggcgggacgacccaccgcaaugaaccccagcagugggugcugccuucuuacagcggaagaaacguucacaaugugcaucuugccccggcugucgcccccacauuuccuggcgagcaacuccuguucuuucgguccaccaugcccggguguagcggauauccuaacauggaccuggauugccugcucccccaggagugggugcagcacuucuaccaggaagcggcuccugcccaaucugacguggcccugcuucgcuuuguuaaucccgauacaggcagaguccuguucgaguguaaacuccauaaguccggguaugugaccguggcucacacgggccagcacgaccuggucaucccgccuaacggauacuuucgguucgauagcugggugaaccaguucuauacccuugcccccaugggcaaugggacaggaagacgccgguga

SEQ ID NO: 29203 - RNA, 1617 nt, Artificial Sequence
  derived and/or modified sequence opt5 from VP1__Norovirus_and/or_Norovirus-like__AB541252
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucaucguccagccucagaauggacgguguacaaccgauggcgugcuccuggggacgacacaacugucccccguuaacaucugcaccuuucgcggagacgugacacauauugcuggcagcagaaauuacaccaugaaccucgcgucucugaauuggaacaauuaugauccuaccgaggaaauccccgccccucuuggcacacccgacuucgucgggaaaauucagggagugcugacgcagaccacaaagggcgacggguccacccggggacacaaggcuacagucuacaccggcagcgccgauuuuacgccgaaacucggguccgugcaguucggaacagacaccgagaacgauuuugaaacccaucaaaauacaaaguucaccccuguuggcgugauccaggacggcucuacaacgcaccgcaacgagccccagcaauggguccugcccagcuacuccgggagaaaugugcacaacguucaucuugccccugcuguggccccgaauuuucccggagaacagcuccuguucuuucggagcaccaugccuggcuguucuggguaucccaacauggaucuggacugccugcucccucaggaguggguccagcacuucuaccaagaggcggcucccgcccaguccgauguggcccugcuucgcuuugugaacccugacacaggaagaguucuguucgaauguaaacuccauaagagcggcuaugucaccguggcucacacagggcagcacgaucuggugauucccccgaauggcuacuuucgguucgacucuugggucaaccaguucuauacccuugccccuaugggaaauggcacggggagacgccgguga

SEQ ID NO: 29204 - RNA, 1617 nt, Artificial Sequence
  derived and/or modified sequence opt5 from VP1__Norovirus_and/or_Norovirus-like__GU270580
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcagcagaaacuacaccaugaaucucgcuacacagaacuggaacucuuaugaucccacggaggaaauuccugcgccccugggcaccccggacuucguggggaaaauccagggaguccuuacacagaccacacgggccgacggcuccacccgcgggcacaaggcuacgguguacacaggaagcgccgauuuuuccccuaagcugggccggauucaauucgccaccgacaccgauaaugacuuugaugcuaaucagaacacaaaauucacccccguuggggugauccaggacggaaauacagcccauagaaacgagccccaacaguggguccucccuucuuacagcggccgcaauucccacaacgugcaccuggcgccggcuguugcccccacguuuccuggcgaacagcuucuguucuuuagaagcaccaugcccggguguucuggauauccuaauauggaucucgacugccugcugccccaggagugggugcaauacuucuaucaggaagccgcuccugcccaguccgaugucgcucuccugcgguuugugaaccccgacacaggcagagugcuuuucgaguguaagcugcauaaaaccggguacguuacagucgcccacaccggacagcaugaucucgugauuccgccuaacggcuauuuucgcuucgacagcugggugaaucaauucuacacgcuggcgcccauggggaacggcaccggacggagacgcuga

SEQ ID NO: 29205 - RNA, 1617 nt, Artificial Sequence
  derived and/or modified sequence opt5 from VP1__Norovirus_and/or_Norovirus-like__EU876882
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggaacaauuacgauccuacagaggaaauucccgccccucugggcacgcccgacuuuguggggaagauccagggaaugcuuacccagacaacccgcucugacggcuccacaagagggcacaaagcuaccguccugacgggaagcgccgauuucgccccgaagcucggccgggugcaauuugcuacagacaccgauaacgacuucgaguccgggcagaauaccaaguuuacaccuguuggagugauucaggauggcucuaccacacaucgcaacgaaccccaacaguggguccugcccaauuacagcggcagaacggggcacaacgugcaccuugccccugcgguugcuccgaccuaucccggagagcagcuccuguucuuucgguccacaaugccuggcuguagcggguaccccaauauggaccuggauugccugcucccucaggaaugggugcaacauuucuaucaggaggccgcccccgcucagucugacgucgcccugcuuagauuugugaacccugauaccggacgcgugcuguucgaguguaaacuccacaaguccggcuacguuacagucgcucauaccgggcagcacgaccuggugauucccccgaacggcuauuuucgguucgauagcugggugaaucaauuuuacacgcuugccccuaugggaaacggcgcggggagacgccgguga

SEQ ID NO: 29206 - RNA, 1617 nt, Artificial Sequence
  derived and/or modified sequence opt5 from VP1__Norovirus_and/or_Norovirus-like__AB933649
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacgggguccgccccguuuacaccuaaacucggaagcguucaguucuccaccgacaccgaaaacgauuuugaggcccaucagaauacaaaguucacccccgugggcgucauucaagacggcucuacaacgcaccgcaacgaaccccagcagugggugcugccuagcuacuccgggggaaauguucaaaacgugcaccuugcuccggccgucgcgcccaccuuuccuggcgagcagcuccuguucuuuagaagcacaaugcccggguguucuggauauccuaauauggaucuggacugccugcucccccaggagugggugcagcauuucuaccaagaagcugccccugcccaguccgauguggcucugcuucgguuuguuaaccccgacaccggccgcguccuguucgaguguaaacuccacaagagcggguaugugacaguggcccauaccggccagcacgaucuggucaucccgccuaacggauacuuuagauucgacucuugggugaaucaguucuauacgcuugcucccaugggcaacgggaccggacggagacgcuga

SEQ ID NO: 29207 - RNA, 1617 nt, Artificial Sequence
  derived and/or modified sequence opt5 from VP1__Norovirus_and/or_Norovirus-like__JX439816
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuuucuccuaagcugggcagaguucaauucgccaccgacaccgauaaugacuuugaugccaaucagaacacaaaauucacccccgugggggucauucaggacggagauacagcucaucggaaugagccccaacagugggugcucccuagcuacuccggccgcaacagccacaauguucaccuggccccggcgguggcucccacguuuccuggcgaacagcuucuguucuuuagaucuaccaugcccggguguuccggauauccuaacauggaccucgauugccugcugccccaggaguggguccaauacuucuaucaggaagccgccccugcucagagcgacguggcccuccugcgguuugugaaucccgauacaggcagaguucuuuucgaguguaagcugcauaaaucuggguacgucaccguggcucacacaggacagcaugaccucgugaucccgccuaacggcuauuuucgcuucgacagcugggucaaccaauucuacacccuggcccccauggggaauggcacgggacggagacgcuga

SEQ ID NO: 29208 - RNA, 1617 nt, Artificial Sequence
  derived and/or modified sequence opt5 from VP1__Norovirus_and/or_Norovirus-like__JX155739
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgagaacgacuuugaaacccaucaaaauacaaaguucacccccgugggagucauucaggauggcagcacaacgcaccgcaacgagccccagcaaugggugcugccuuccuacagcggcagaaauguucagaacgugcaccuugccccggcugucgcccccaccuuuccuggggaacagcuccuguucuuucggucuacaaugcccggauguuccggcuauccuaauauggaccuggauugccugcucccccaggagugggugcaacauuucuaccaggaggcggcuccugcccagagcgacguggcccugcuucgcuuuguuaaccccgauaccgggagaguccuguucgaauguaaacuccacaagucuggauaugugacaguggcucauaccggccagcacgaccuggucaucccgccuaacggguacuuucgguucgauagcugggugaaucaauucuauacgcuugcccccaugggcaacggaaccggcagacgccgguga

SEQ ID NO: 29209 - RNA, 1617 nt, Artificial Sequence
  derived and/or modified sequence opt5 from VP1__Norovirus_and/or_Norovirus-like__HQ456338
augaagauggccagcaacgacgcuucccccucugauggcagcgccgcgaaucuggugccugaggucaacaaugaaguuauggcucucgagccgguggugggggccgccaucgcugcccccgucgcuggacagaaaaacgugaucgacccuuggaucagaaauaacuucguucaagcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaagauuaucuucgccgcuguuccucccaauuuuccuacggagggacugucccccucucaggugaccauguucccgcauaucauugucgacgugagacagcucgagccugugcugaucccccugccugauguccggaacaauuuuuaucacuacaaccaaagcaaugacuccacaauuaaacucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaagccuuucacgguucccauccugaccguggaagagaugacaaauagcagauuuccuauuccccuugagaaacuguucaccgggccgucuggagccuucgucgugcagccucagaacggccgguguacaaccgacgggguucuccugggaacgacacagcugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaagauccaaggcguccugacgcagaccacaaaggccgacgggucuacccggggacacaaagccacaguguacaccggcuccgcugacuuuacgccgaagcucgggagcguucaguucuccacagauaccgaaaaugacuuugagacccaucagaacacaaaauucaccccugugggagucauucaagauggcucuacaacgcaccgcaaugaaccccagcagugggugcugcccagcuacuccggcagaaacguucacaaugugcaucuugccccugcggucgcuccgaccuuucccggggagcaacuccuguucuuucggagcacaaugccuggauguucuggcuaucccaacauggaccuggauugccugcucccucaggagugggugcagcacuucuaccaggaagccgcccccgcucaauccgacguggcccugcuucgcuuuguuaauccugauaccgggagaguccuguucgaguguaagcuccauaaaagcggauaugugacaguggcucacaccggccagcacgaccuggucauucccccgaacggguacuuucgguucgauucuugggugaaccaguucuauacgcuugccccuaugggcaauggaaccggcagacgccgguga

SEQ ID NO: 29210 - RNA, 1617 nt, Artificial Sequence
  derived and/or modified sequence opt5 from VP1__Norovirus_and/or_Norovirus-like__AB541359
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccgugcugacagucgaagagaugaccaacuccagauuuccuaucccccuugagaagcuguucacagggccgagcggagccuucgugguucagccucagaauggccgguguaccacggacggggugcuccugggaacaacccagcugucucccgucaacauuugcacauuucgcggcgaugugacccauaucgcuggcuccagaaauuacaccaugaaccucgcgagccugaauuggaacaauuaugacccuacagaagagauccccgccccucuugggacgcccgauuucgucggaaaaauucaaggcgugcugacccagacaaccaagggggacggaucuacacggggccacaaggcuaccguuuacacgggguccgccccguuuacaccuaaacucggaagcgugcaguucuccaccgacaccgaaaacgauuuugagacacaucagaauaccaaguucacacccgucggcgugauccaagacggcucuacgacccaccgcaacgaaccccagcaguggguucugccuagcuacuccgggagaaaugugcacaacguccaucuugccccggcuguggcccccacauuuccuggagagcaacuccuguucuuucggagcaccaugcccggcuguucuggguauccuaauauggaucuggacugccugcucccccaggagugggugcagcacuucuaccaggaagcggcuccugcccaauccgagguugcccugcuucgcuuugucaaccccgauacaggaagagugcuguucgaauguaaacuccauaagagcggcuaugugaccgucgcucacacggggcagcacgaccuggugauuccgccuaacggcuacuuucgguucgauucuuggguuaaucaguucuauacccuugcccccaugggaaacggcacagggagacgccgguga

SEQ ID NO: 29211 - RNA, 1617 nt, Artificial Sequence
  derived and/or modified sequence opt5 from VP1__Norovirus_and/or_Norovirus-like__AB541280
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugaucgacccuuggaucagaaacaauuucguucaagcccccggcggggaauuuacagugagcccucggaacgcgcccggagagauucugugguccgccgcucuuggcccugaucugaauccguaccucucucaccuggcccgcauguauaacggguacgcuggaggcuucgaaguccaggugauccuugccggcaaugcguuuacggccgggaaaauuaucuucgcugccguucccccuaacuuucccaccgagggacugagcccuucccaggugacaauguucccccauaucauugucgacgugagacagcucgagccggugcugaucccucugcccgauguccggaauaacuuuuaucacuacaaucaaucuaacgacagcaccauuaagcucaucgcuaugcuguauacaccucuucgcgccaacaaugccggcgaagauguuuucaccguguccugcagagugcugacacggcccagccccgacuuugauuucauuuuucucgucccuccgaccguggagucucgcacgaaacccuucaccguuccuauccugacaguggaagagaugaccaacuccagauuucccauuccucuugagaagcuguucacagggcccagcggagcuuucgucgugcagccgcagaauggccgguguaccacggacgggguucuccugggaacaacccagcugucuccugugaacaucugcacauuucgcggcgaugucacccauaucgcgggcuccagaaauuacaccaugaaccucgccagccugaauuggaacaauuaugaccccacagaagagauuccugcuccccuugggacgccugauuucgugggaaaaauccaaggcguccugacccagacaaccaagggggacggaucuacacggggccacaaggccaccguguacacgggguccgcccccuuuacaccgaaacucggaagcguucaguucuccaccgacaccgaaaacgauuuugagacacaucagaauaccaaguucacaccugugggcgucauucaagacggcucuacgacccaccgcaacgaaccccagcagugggugcugcccagcuacuccgggagaaauguucacaacgugcaucuugcuccugccgucgcgccgacauuucccggagagcaacuccuguucuuucggagcaccaugccuggcuguucuggguaucccaauauggaucuggacugccugcucccucaggagugggugcagcacuucuaccaggaagcugcccccgcccaauccgauguggcucugcuucgcuuuguuaacccugacacaggaagaguccuguucgaguguaaacuccauaagagcggcuaugugaccguggcccacacggggcagcacgaucuggucauucccccgaacggcuacuuucgguucgacucuugggugaaucaguucuauacccuugcuccuaugggaaacggcacagggagacgccgguga

SEQ ID NO: 29212 - RNA, 1617 nt, Artificial Sequence
  derived and/or modified sequence opt5 from VP1__Norovirus_and/or_Norovirus-like__AB541244
augaagauggccagcaacgacgcuaaucccuccgauggcucugccgcgaaccuggugccugaggucaauaacgaagggauggcucucgagccgguugugggagccgccaucgcugcccccguggcuggccagaccaaugucaucgacccuuggaucagaaacaauuucgugcaagcccccgggggagaauuuacaguuagcccucggaacgcgcccuccgagauucuguggucugccagccuuggcccugaucugaauccguaccucucccaccuggcucgcauguauaacggguacgccggaggcuucgaagugcaggucauccuugcuggcaaugccuuuacggcggggaaaauuaucuucgccgcugugcccccuaacuuucccaccgagggacugucuccuagccagguuacaauguucccccauaucauuguggacgucagacagcucgagccggugcugaucccucugcccgaugugcggaauaacuuuuaucacuacaaucaauccaacgacagcaccauuaagcucaucgccaugcuguauacaccucuucgcgcuaacaaugccggcgaagaugucuucaccguuucuugcagagugcugacacggcccucccccgacuuugauuucauuuuucucgugccuccgaccgucgagagccgcacgaaacccuucaccgugccuauccugacaguugaagagaugaccaacucuagauuucccauuccucuugagaagcuguucacagggcccuccggagccuucgugguccagccgcagaauggccgguguaccacggacggggugcuccugggaacaacccagcugagcccuguuaacaucugcacauuucgcggcgaugugacccauaucgcuggcucuagaaauuacaccaugaaccucgcgucccugaauuggaacaauuaugaccccacagaagagauuccugcuccccuugggacgccugauuucgucggaaaaauccaaggcgugcugacccagacaaccaaggggaacggaagcacacggggccacaaggccaccgucuacacgggguccgcccccuuuacaccgaaacucggaucugugcaguucagcaccgacaccgaaaaugacuuugagacacaucagaacaccaaguucacaccuguuggcgugauucaagauggcuccacgacccaccgcaaugaaccccagcaguggguccugcccagcuacucugggagauccgugcacaacguucaucuugccccugcuguggccccgacauuucccggagagcaacuccuguucuuucggagcaccaugccuggcuguucuggguaucccaauauggaccuggauugccugcucccucaggaguggguccagcacuucuaccaggaagcggcucccgcccaaagcgacguggcccugcuucgcuuugugaacccugauacaggaagaguucuguucgaguguaaacuccauaaguccggcuaugucaccguggcucacacggggcagcacgaccuggugauucccccgaacggcuacuuucgguucgauucuugggucaaucaguucuauacccuugccccuaugggaaacggcacagggagacgccgguga

SEQ ID NO: 29213 - RNA, 1617 nt, Artificial Sequence
  derived and/or modified sequence opt5 from VP1__Norovirus_and/or_Norovirus-like__AB541203
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgugggcuccagaaauuacaccaugaaccucgcuagccugaauuggaacaauuaugacccuacagaagagauucccgcgccucuugggacgcccgauuucgucggaaaaauccaaggcgugcugacccagacaaccaagggggacggaucuacacggggccacaaggccaccguuuacacgggguccgcuccguuuacaccuaaacucggaagcgugcaguucuccaccgacaccgaaaacgauuuugaggcccaucagaauacaaaguucacccccgucggcgugauucaagacggcucuacaacgcaccgcaacgaaccccagcaguggguucugccuagcuacuccgggagaaaugugcaaaacguccaccuugccccggcuguggcccccaccuuuccuggagagcagcuccuguucuuucggagcacaaugcccggcuguucuggguauccuaauauggaucuggacugccugcucccccaggagugggugcagcauuucuaccaagaagcggcuccugcccaguccgauguugcccugcuucgcuuugucaaccccgacaccggaagagugcuguucgaguguaaacuccacaagagcggcuaugugacagucgcucauaccgggcagcacgaucuggugaucccgccuaacggcuacuuucgguucgacucuuggguuaaucaguucuauacgcuugcccccaugggaaacggcaccgggagacgccgguga

SEQ ID NO: 29214 - RNA, 1617 nt, Artificial Sequence
  derived and/or modified sequence opt5 from VP1__Norovirus_and/or_Norovirus-like__GQ850882
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggaacaauuacgauccuacagaggaaauucccgccccucugggcacgcccgacuuuguggggaagauccagggaaugcuuacccagacaacccgcucugacggcuccacaagagggcacaaagcuaccgucuucacgggaagcgccgauuuugccccgaagcugggccgggugcaauucgcuacagacaccgauaacgacuuugaguccgggcagaauaccaaguucacaccuguuggagugauucaggauggcucuaccacacaucgcaacgaaccccaacaguggguccuccccaauuacagcggcagaacggggcacaacgugcaccuggccccugcgguugcuccgaccuaucccggagagcagcuucuguuuuuccgguccacaaugccuggcuguagcggguaccccaauauggaccucgauugccugcugccucaggaaugggugcaacauuuuuaucaggaggccgcccccgcucagucugacgucgcccuccugagauucgugaacccugauaccggacgcgugcuuuuugaguguaaacugcacaaguccggcuacguuacagucgcucauaccgggcagcacgaccucgugauucccccgaacggcuauuuccgguuugauagcugggugaaucaauucuacacgcuggccccuaugggaaacggcaccgggagacgccgguga

SEQ ID NO: 29215 - RNA, 1617 nt, Artificial Sequence
  derived and/or modified sequence opt5 from VP1__Norovirus_and/or_Norovirus-like__KR131772
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucaccggcagcagaaacuacacaaugaaucucgccacgcagaacuggaacucuuaugaucccaccgaggaaauuccugcuccccugggcacaccggacuucguggggaaaauccagggaguccuuacccagacaacccgggcggacggcuccacgcgcgggcacaaggccacaguguacaccggaagcgcugauuuugccccuaagcugggcagaguucaauucgccaccgacacagauaaugacuuugaugcuaaucagaacaccaaauucacacccgugggggucauucaggacggaaauacggcccaucggaacgagccccaacagugggugcucccuuccuacucuggccgcaauagccacaacguucaccuggcgccggcuguggcccccaccuuuccuggcgaacagcuucuguucuuuagauccacaaugcccggguguagcggauauccuaauauggaucucgacugccugcugccccaggaguggguccaauacuucuaucaggaagccgcuccugcccagucugauguggcucuccugcgguuugugaaccccgacaccggcagaguucuuuucgaguguaagcugcauaaauccggguacgucacaguggcccacaccggacagcaugaucucgugaucccgccuaacggcuauuuucgcuucgacagcugggucaaucaauucuacacgcuggcgcccauggggaacggcaccggacggagacgcuga

SEQ ID NO: 29216 - RNA, 1617 nt, Artificial Sequence
  derived and/or modified sequence opt5 from VP1__Norovirus_and/or_Norovirus-like__KR904215
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccuauccugacgguggaggaaaugaccaauagcagauuucccauuccgcuugagaagcuguucacagggccuucuuccgccuucgucgugcagccccagaacggacgguguaccacagauggcguucuccuggggaccacgcaacugagcccugugaauaucugcacauuucgcggagacgucacccauacaaccggcucucacaacuacaccaugaaucucgcuacacagaacugguccagcuaugaucccacggaggaaaucccugcgccccugggcaccccggacuucguggggaaaauucagggaguccuuacacagaccacaaagaccgacggcuccacgagagggcauaaggccacaguguacaccggaucugcugauuuugccccuaaacugggccggguucaauucgccaccgacacagauaaugacuuugaggcuaaccagaauaccaaguucacacccgugggggucauccaggauggaaacacggcccaccgcaaugaaccccaacagugggugcucccuagcuacuccggcagaaacacccacaauguucaucuggcgccggcuguggcccccacauuuccuggcgagcagcuucuguucuuucggagcaccaugcccggguguucuggauauccuaacauggaccucgauugccugcugccccaggaauggguccaauacuucuaucaggaggccgcuccugcccaguccgacguggcucuccugcgcuuugugaaucccgauacaggcagaguucuuuucgaguguaaacugcacaagagcggguacgucaccguggcccauacgggaccgcacgaccucgugauuccucccaacggcuauuuucgguucgauucuugggucaaccaguucuacacccuggcgccuauggggaauggcacaggaagacgccgguga

SEQ ID NO: 29217 - RNA, 1617 nt, Artificial Sequence
  derived and/or modified sequence opt5 from VP1__Norovirus_and/or_Norovirus-like__AB933715
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucggaacagacaccgaaaacgauuuugagacccaucaaaauacaaaguucacccccgugggcgucauucaggacggcgggacaacgcaccgcaacgaaccccagcaaugggugcugccuucuuacagcggaagaaauguuccgaacgugcaccuugcccccgcugucgccccuaccuuucccggcgagcagcuccuguucuuucgguccacaaugccuggguguagcggauaucccaauauggaucuggacugccugcucccucaggagugggugcagcauuucuaccaagaagcggcucccgcccagucugauguggcccugcuucgcuuuguuaacccggacaccggcagaguccuguucgaguguaaacuccacaaguccggguaugugacaguggcucauaccggccagcacgaucuggucaucccucccaacggauacuuucgguucgacagcugggugaaucaguucuauacgcuugccccuaugggcaacgggaccggaagacgccgguga

SEQ ID NO: 29218 - RNA, 1617 nt, Artificial Sequence
  derived and/or modified sequence opt5 from VP1__Norovirus_and/or_Norovirus-like__AB933695
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaagauguuuucaccguguccugcagagugcugacacggcccagcccugacuuugauuucaucuuucucgucccgcccaccguggagucucgcacaaaaccuuucaccguucccauucugacgguggaagagaugaccaacuccagauuuccuaucccccuugagaagcuguucacagggccgagcucugccuucgucgugcagccucagaauggacgguguaccacagacggcguucuccuggggaccacgcaacugucccccgugaacaucugcacauuucgcggagaugucacccauauugcuggcagccacaauuacacaaugucucucgcgucccugaacuggaauaacuaugacccuaccgaagagauccccgccccucuuggcacccccgauuucguggggaaaauucagggaguccugacacagacgaccaagggcgacgggagcacaagaggacauaaggcuaccguguacacaggcuccgccccguuuaccccuaaacucgggucuguucaguucagcacggacacagaaaaugauuuugagacccaccaaaacaccaaguucacacccgugggagucauccaggacggcggcaccacacaccggaaugaaccccagcaaugggugcugccuuccuacagcgggcgcaacguuccgaaugugcaucuugcccccgcugucgccccuacguuucccggagagcagcuccuguucuuuagaucuaccaugccuggcuguuccggguaucccaacauggaucuggacugccugcucccucaggagugggugcagcacuucuaccaagaagcggcucccgcccagagcgauguggcccugcuucgguuuguuaauccggacacaggacgcguccuguucgaguguaaacuccauaagucuggcuaugugaccguggcucacacagggcagcacgaucuggucauuccucccaacggcuacuuuagauucgacagcugggugaaccaguucuauacccuugccccuaugggaaauggcacggggcggagacgcuga

SEQ ID NO: 29219 - RNA, 1617 nt, Artificial Sequence
  derived and/or modified sequence opt5 from VP1__Norovirus_and/or_Norovirus-like__AB933681
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagagacuacaccaugaaucucgcgucucugaacuggaauaacuaugauccuaccgaagagauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgaaaaugacuuugagacccaucaaaacgccaaguucacacccgugggagucauucaggauggcagcaccacacaccgcaaugaaccccagcaaugggugcugccuuccuacagcggcagaaacguuccgaaugugcaccuugcucccgccgucgcgccuacguuucccggggagcagcuccuguucuuucggucuaccaugccuggauguuccggcuaucccaacauggaccuggauugccugcucccucaggagugggugcagcauuucuaccaagaagcugcccccgcccagagcgacguggcucugcuucgcuuuguuaauccggauacagggagaguccuguucgaguguaaacuccacaagucuggauaugugaccguggcccauacaggccagcacgaccuggucaucccucccaacggguacuuucgguucgauagcugggugaaccaguucuauacccuugcuccuaugggcaauggaacgggcagacgccgguga

SEQ ID NO: 29220 - RNA, 1617 nt, Artificial Sequence
  derived and/or modified sequence opt5 from VP1__Norovirus_and/or_Norovirus-like__AB933675
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccgugcugaccgucgaagagaugacaaacuccagauuuccuaucccccuugagaagcuguucaccgggccgagcucugccuucgugguucagccucagaauggacgguguacaaccgacggcgugcuccuggggacgacacaacugucccccgucaacauuugcaccuuucgcggagaugugacacauaucgcuaauagccacaacuacaccaugaaucucgcgucucugaacuggaauaacuaugacccuaccgaagagauccccgccccucuuggcacacccgauuucgucggcaaaauucagggggugcugacgcagaccacaaagggagacggcuccaccagagggcauaaggcuacaguuuacaccggaagcgccccguuuacgccuaaacucggcuccgugcaguucucuacagacaccgaaaaugauuuugagacccaccaaaacacaaaguucacccccgucggggugauccaggacggaggcacaacgcaccggaaugaaccccagcaauggguucugccuagcuacuccggccgcaacgugcagaauguccaucuugccccggcuguggcccccaccuuuccuggggagcagcuccuguucuuuagaagcacaaugcccggauguucuggcuauccuaacauggaucuggacugccugcucccccaggagugggugcaacacuucuaccaggaagcggcuccugcccaguccgauguugcccugcuucgguuugucaaccccgacaccgggcgcgugcuguucgaguguaaacuccauaagagcggauaugugacagucgcucacaccggccagcacgaucuggugauuccgccuaauggguacuuuagauucgacucuuggguuaaccaauucuauacgcuugcccccaugggcaauggaaccggccggagacgcuga

SEQ ID NO: 29221 - RNA, 1617 nt, Artificial Sequence
  derived and/or modified sequence opt5 from VP1__Norovirus_and/or_Norovirus-like__AB933652
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucuacauucgucgugcagccucagaauggacgguguaccacggacggcguucuccuggggacaacccaacugucccccgugaacaucugcacauuucgcggagaugucacccauaucgccggcagcagaaauuacaccaugaaccucgcuucucugaauuggaacaauuaugacccuacagaagagauucccgcgccucuuggcacgcccgauuucguggggaaaauccagggaguccugacccagacaaccaagggcgacggguccacacggggacacaaggccaccguguacacgggcagcgcuccguuuacaccuaaacucggguccguucaguucggaaccgacaccgaaaacgauuuugagacacaucaaaauaccaaguucacacccgugggcgucauucaggacggcgggacgacccaccgcaacgaaccccagcaaugggugcugccuucuuacagcggaagaaauguuccgaacgugcaccuugcccccgccgucgcuccuacauuucccggcgagcagcuccuguucuuucgguccaccaugccuggguguagcggauaucccaauauggaucuggacugccugcucccucaggagugggugcagcauuucuaccaagaagccgcgcccgcucagucugauguggcccugcuucgcuuuguuaacccggacacaggcagaguccuguucgaguguaaacuccacaaguccggguaugugaccguggcccauacgggccagcacgaucuggucaucccucccaacggauacuuucgguucgacagcugggugaaucaguucuauacccuugcuccuaugggcaacgggacaggaagacgccgguga

SEQ ID NO: 29222 - RNA, 1617 nt, Artificial Sequence
  derived and/or modified sequence opt5 from VP1__Norovirus_and/or_Norovirus-like__KF429762
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccauccugacgguggaggaaaugaccaacagcagauuuccuauuccccuugagaagcuguucacagggccgucuuccaccuucgucgugcagccucagaauggacgguguacaaccgauggcguucuccuggggacgacacaacugagccccgugaacaucugcaccuuucgcggagacgucacacauaucaccggcucuagaaauuacaccaugaaccucgccucccagaauuggaacagcuaugauccuacagaggaaauucccgcuccucugggcacgcccgacuucguggggaaaauccagggaguccuuacccagacaacccggacagacggcuccacccgcgggcacaaggcgacgguguacacaggaucugccgauuuuagcccgaagcugggcagaguucaauucgcuaccgacaccgauaaugacuuugaugccaaccagaauacaaaauucaccccugugggggucauucaggacggaggcacaacgcaucggaacgagccccaacagugggugcuccccuccuacagcggccgcaauacccacaacguucaccuggccccugcuguggccccgacauuucccggggaacagcuucuguucuuuagaucuaccaugccuggauguuccggcuaucccaauauggaucucgacugccugcugccucaggaguggguccaacauuucuaccaggaagcggcucccgcccagagcgauguggcccuccugcgguuugugaacccugacacagggagaguucuuuucgaguguaagcugcacaaaucuggauaugucaccguggcucauacgggccagcacgaucucgugauucccccgaacggguacuuucgcuucgacagcugggucaaucaauucuauacccuggccccuaugggcaacggaacaggccggagacgcuga

SEQ ID NO: 29223 - RNA, 1617 nt, Artificial Sequence
  derived and/or modified sequence opt5 from VP1__Norovirus_and/or_Norovirus-like__JX644027
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucuaaaaccaagccuuucacgguucccauccugaccguggaagagaugacaaacucccgcuuuccuauuccccuugagaaacuguucaccgggccgagcucugccuucgucgugcagccucagaauggaagauguacaaccgacggcguucuccuggggacgacacaacugucccccgugaacaucugcaccuuucggggagaugucacacauaucgcuggcagccgcaauuacaccaugaaccucgcgucucugaauuggaacaauuaugacccuaccgaagagauucccgccccucuuggcacacccgauuucguggggaagauccagggaguccugacgcagaccacaaagggcgacggguccaccagaggacacaaagcuacaguguacaccggcagcgccccguuuacgccuaagcucggguccguucaguucucuacagacaccgaaaacgauuuugagacccaucaaaauacaaaauucacccccgugggagucauucaggacggcagcacaacgcaccggaacgaaccccagcaaugggugcugccuuccuacagcggccgcaaugcccagaacguucaccuugcuccggccguggcgcccaccuuuccuggggagcagcuccuguucuuuagaucuacaaugcccggauguuccggcuauccuaauauggaucuggacugccugcucccccaggaguggguccaacauuucuaccaggaagcugccccugcccagagcgauguggcucugcuucgguuugugaaccccgacaccgggcgcguucuguucgaguguaagcuccacaaaucuggauaugucacaguggcccauaccggccagcacgaucuggugaucccgccuaacggguacuuuagauucgacagcugggucaaucaauucuauacgcuugcucccaugggcaacggaaccggccggagacgcuga

SEQ ID NO: 29224 - RNA, 1617 nt, Artificial Sequence
  derived and/or modified sequence opt5 from VP1__Norovirus_and/or_Norovirus-like__JN400617
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcugacuuuacgccgaaacucgggagcguucaguucuccacagauaccgaaaaugacuuugagacccaucaaaacacaaaguucaccccugugggagucauucaggauggcucuacaacgcaccgcaaugaaccccagcaaugggugcugcccagcuacuccggcagaaacguucagaaugugcaccuugccccugcggucgcuccgaccuuucccggggagcagcuccuguucuuucggagcacaaugccuggauguucuggcuaucccaacauggaccuggauugccugcucccucaggagugggugcaacauuucuaccaggaagccgcccccgcucaguccgacguggcccugcuucgcuuuguuaauccugauaccgggagaguccuguucgaguguaaacuccacaagagcggauaugugacaguggcucauaccggccagcacgaccuggucauucccccgaacggguacuuucgguucgauucuugggugaaccaauucuauacgcuugccccuaugggcaauggaaccggcagacgccgguga

SEQ ID NO: 29225 - RNA, 1617 nt, Artificial Sequence
  derived and/or modified sequence opt5 from VP1__Norovirus_and/or_Norovirus-like__JQ613519
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcugacuuuacgccgaaacucgggagcguucaguucuccacagauaccgaaaaugacuuugagacccaucaaaacacaaaguucaccccugugggagucauucaggauggcaauacaacgcaccgcaacgaaccccagcaaugggugcugcccucuuacagcggcagaaauguucacaacgugcaucuugccccugcggucgcuccgaccuuucccggggagcagcuccuguucuuucgguccacaaugccuggauguagcggcuaucccaauauggaccuggauugccugcucccucaggagugggugcagcacuucuaccaagaagccgcccccgcucagucugacguggcccugcuucgcuuuguuaacccugauaccgggagaguccuguucgaguguaaacuccauaaguccggauaugugacaguggcucacaccggccagcacgaccuggucauucccccgaacggguacuuucgguucgauagcugggugaaucaguucuauacgcuugccccuaugggcaacggaaccggcagacgccgguga

SEQ ID NO: 29226 - RNA, 1617 nt, Artificial Sequence
  derived and/or modified sequence opt5 from VP1__Norovirus_and/or_Norovirus-like__HQ456341
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaacucuagauuucccauuccgcuugagaagcuguucaccgggccuuccagcgccuucgucgugcagccccagaauggacgguguacaaccgauggcguuuuucucgggacgacacaacugucuccugugaacaucugcaccuuccgcggagacgucacacauaucaccggcuccagaaauuacaccaugaaccuggccacacagaauuggaacagcuaugaucccacggaggaaauuccugcuccccucggcaccccggacuuuguggggaaaauccagggaguccugacacagaccacacgggcggacggcuccacccgcgggcacaaggccacgguguacacaggaucugcugauuucgccccuaaacuuggcagaguucaauuugccaccgacaccgauaaugacuucgaugcuaaccagaauacaaaguuuacccccgugggggucauucaggacggagauacagcccaucggaacgagccccaacagugggugcugccuagcuacuccggccgcaauagccacaacguucaccucgcgccggcuguggcccccacguucccuggcgaacagcugcuguuuuucagaucuaccaugcccggguguuccggauauccuaauauggaccuugauugccuccugccccaggaguggguccaauacuuuuaucaggaagccgcuccugcccagagcgacguggcucugcuccgguucgugaaccccgauacaggcagaguucuguuugaguguaaacuucauaagucuggguacgucaccguggcccacacaggacagcaugaccuggugaucccgccuaauggcuauuuccgcuucgacagcugggucaaccaauuuuacacccucgcgcccauggggaacggcacgggacggagacgcuga

SEQ ID NO: 29227 - RNA, 1617 nt, Artificial Sequence
  derived and/or modified sequence opt5 from VP1__Norovirus_and/or_Norovirus-like__HM802540
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcagcucucuaccgauacaagcaaugacuucgagaccgggcagaacacaagauuuacgcccgucggagugguucaagauggcuccaccacacaccagaaugaaccccagcagugggugcugccugacuacagcggccgggauucucacaacguccaucuugcuccggccguggcccccaccuucccuggggagcaacugcucuuuuuccgcuccacaaugcccggauguagcggcuacccuaauaugaaccuggacugccugcucccccaggaaugggugcagcacuuuuaucaggagucugcuccugcccaaagcgauguugcgcugcuuagauucgucaaucccgacaccgggcgggugcuguuugaguguaaacuccauaaguccggauacgugacggucgcucacaccggccagcacgaucuggugauuccgccuaacggguauuucagauuugacucuuggguuaaccaguucuacacacuugcccccaugggcaauggagccggccgccggagauga

SEQ ID NO: 29228 - RNA, 1617 nt, Artificial Sequence
  derived and/or modified sequence opt5 from VP1__Norovirus_and/or_Norovirus-like__AB541257
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacgggguccgccccguuuacaccuaaacucggaagcguucaguucuccaccgacaccgaaaacgauuuugaggcccaucagaauacaaaguucacccccgugggcgucauucaagacggcucuacaacgcaccgcaacgaaccccagcagugggugcugccuagcuacuccgggagaaaugcucaaaacguucaccuugccccggcgguggcucccaccuuuccuggagagcagcuccuguucuuucggagcacaaugcccggcuguucuggguauccuaauauggaucuggacugccugcucccccaggaguggguccagcauuucuaccaagaagccgccccugcucaguccgauguggcccugcuucgcuuugugaaccccgacaccggaagaguucuguucgaguguaaacuccacaagagcggcuaugucacaguggcucauaccgggcagcacgaucuggugaucccgccuaacggcuacuuucgguucgacucuugggucaaucaguucuauacgcuugcccccaugggaaacggcaccgggagacgccgguga

SEQ ID NO: 29229 - RNA, 1617 nt, Artificial Sequence
  derived and/or modified sequence opt5 from VP1__Norovirus_and/or_Norovirus-like__AB541242
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccagccuuggcccugaucugaacccguaccucucccaccuggcucgcauguauaauggguacgccggaggcuucgaaguccaggugauccuugcuggcaacgccuuuacagcggggaaaauuaucuucgccgcuguucccccuaauuuucccacggagggacugucuccuagccaggugaccauguucccccauaucauugucgacgugagacaacucgagccggugcugaucccucugcccgauguccggaacaauuuuuaucacuacaaccaguccaaugacagcacaauuaagcucaucgccaugcuguauaccccucuucgcgcuaacaacgccggcgaagauguuuucacagugucuugcagagugcugacccggcccucccccgacuuugauuucauuuuucucgucccuccgacaguggagagccgcaccaaacccuucacgguuccuauccugaccguggaagagaugacaaauucuagauuucccauuccucuugagaagcuguucaccgggcccuccagcgccuucgucgugcagccgcagaacggacgguguacaaccgacggcguucuccuggggacgacacaacugucuccugugaauaucugcaccuuucgcggagaugucacacauaucgcuggcuccagaaacuacaccaugaaucucgcgagccugaacuggaauaacuaugaccccaccgaagagauuccugcuccccuuggcacaccugauuucguggggaaaauccagggaguccugacgcagaccacaaagggcgacggguccacccggggacacaaggccacaguguacaccggcucugcccccuuuacgccgaaacucgggagcguucaguucuccacagacaccgaaaaugauuuugagacccaucaaaacacaaaguucaccccugugggagucauucaggacggcggcacaacgcaccgcaaugaaccccagcaaugggugcugcccagcuacucugggagaaacguucagaaugugcaccuugccccugcugucgccccgaccuuucccggagagcagcuccuguucuuucgguccacaaugccuggcuguagcggguaucccaacauggaucuggacugccugcucccucaggagugggugcaacauuucuaccaggaagcggcucccgcccagucugauguggcccugcuucgcuuuguuaauccugacaccggaagaguccuguucgaguguaaacuccacaagagcggcuaugugacaguggcucauaccgggcagcacgaucuggucauucccccgaacggcuacuuucgguucgacuccugggugaaccaauucuauacgcuugccccuaugggaaauggcaccgggagacgccgguga

SEQ ID NO: 29230 - RNA, 1617 nt, Artificial Sequence
  derived and/or modified sequence opt5 from VP1__Norovirus_and/or_Norovirus-like__AB541225
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagagacuacaccaugaaccucgcgucccugaauuggaacaauuaugauccuaccgaagagauucccgccccucuuggcacacccgacuucguggggaaaauccagggaguccugacgcagaccacaaagggcgacgggagcacccggggacacaaggcuacaguguacaccggcuccgccccguuuacgccuaaacucgggucuguucaguucagcacagauaccggagacgauuuucaaacccaucagaacacaaaguucacccccgugggcgucauucaggacggcgggacaacgcaccgcaaugaaccccaacagugggugcugccuuccuacagcggaagaaacguuccgaaugugcaccuugcccccgcugucgccccuaccuuucccggcgagcagcuccuguucuuucggucuacaaugccuggguguuccggauaucccaacauggaucuggacugccugcucccucaggaaugggugcaacauuucuaccaggaggcggcucccgcccagagcgauguggcccugcuucgcuuuguuaauccggacaccggcagaguccuguucgaguguaaacuccacaaggcuggguaugugacaguggcccauaccggccagcacgaucuggucaucccucccaacggauacuuucgguucgacucuugggugaaucaauucuauacgcuugcuccuaugggcaacgggaccggaagacgccgguga

SEQ ID NO: 29231 - RNA, 1617 nt, Artificial Sequence
  derived and/or modified sequence opt5 from VP1__Norovirus_and/or_Norovirus-like__AB541190
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggaacaauuacgauccuacagaggaaauucccgccccucugggcacgcccgacuuuguggggaagauccagggaaugcuuacccagacaacccgcucugacggcuccacaagagggcacaaagcuaccguccugacgggaagcgccgauuucgccccgaagcucggccgggugcaauuugcuacagacaccgauaacgacuucgaguccgggcagaauaccaaguuuacaccuguuggagugauucaggauggcucuaccacacaucgcaacgaaccccaacaguggguccugcccaauuacagcggcagaacggggcacaacgugcaccuugccccugcgguugcuccgaccuaucccggagagcagcuccuguucuuucgguccacaaugccuggcuguagcggguaccccaauauggaccuggauugccugcucccucaggaaugggugcaacauuucuaucaggaggccgcccccgcucagucugacauggcccugcuuagauuugucaacccugauaccggacgcgugcuguucgaguguaaacuccacaaguccggcuacgugacaguugcucauaccgggcagcacgaccuggucauucccccgaacggcuauuuucgguucgauagcugggugaaucaauuuuacacgcuugccccuaugggaaacggcaccgggagacgccgguga

SEQ ID NO: 29232 - RNA, 1617 nt, Artificial Sequence
  derived and/or modified sequence opt5 from VP1__Norovirus_and/or_Norovirus-like__AB492092
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucagcggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggaaauacagcccaucggaacgagccccaacagugggugcucccuucuuacagcggccgcaauucccacaacguucaccuggcgccggcuguggcccccacguuuccuggcgaacagcuucuguucuuuagaagcaccaugcccggguguucuggauauccuaauauggaucucgacugccugcugccccaggaguggguccaauacuucuaucaggaagccgcuccugcccaguccgauguggcucuccugcgguuugugaaccccgacacaggcagaguucuuuucgaguguaagcugcauaaaagcggguacgucaccguggcccacacaggacagcaugaucucgugaucccgccuaacggcuauuuucgcuucgacucuugggucaaucaauucuacacccuggcgcccauggggaacggcacgggacggagacgcuga

SEQ ID NO: 29233 - RNA, 1617 nt, Artificial Sequence
  derived and/or modified sequence opt5 from VP1__Norovirus_and/or_Norovirus-like__EU916956
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaaaauucacgcccgucggagugguucaagauggcuccaccacacaccagaaugaaccccagcagugggugcucccugacuacagcggcagagauucucacaacguccaucuggcuccggccguggcccccaccuuuccuggggagcaacuucuguucuuucgguccacaaugcccggauguagcggcuacccuaauaugaaccucgacugccugcugccccaggaaugggugcagcacuucuaucaggagucugcuccugcccaaagcgauguugcgcuccugcgcuuugucaaucccgacaccgggagagugcuuuucgaguguaagcugcauaaauccggauacgugacggucgcucacaccggccagcacgaucucgugauuccgccuaacggguauuuucgguucgacucuuggguuaaccaguucuacacacuggcccccaugggcaauggagccggcagacgccgguga

SEQ ID NO: 29234 - RNA, 1617 nt, Artificial Sequence
  derived and/or modified sequence opt5 from VP1__Norovirus_and/or_Norovirus-like__EF126962
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauucgccucaucgcuaugcuguauacaccccuuagagccaacaacgcuggcgaugacguuuucaccgugagcugccgggugcugacccgcccuuccccggauuuugacuucauuuuucucgugcccccuacggucgaaagcagaaccaagcccuucucuguuccuauccugacaguggaggaaaugaccaauucccgguuucccauuccgcuugagaaacuguucacagggccuagcucugccuucgucgugcagccccagaacggacgcuguaccacggauggcguucuccuggggacaacccaacuguccccugugaauaucugcacauuuagaggagacgucacccauaucgccggcacccagaacuacacaaugaaucucgcuagccagaacuggaauaacuaugaucccacggaggaagugccugcgccccugggcaccccggacuucgucgggaagauucagggagugcuuacacaaaccacacggggcgacgggucuacccgcggacacaaagccacgguuuccacaggcagcgugcauuuuaccccuaagcugggguccguccaguucucuaccgauacaagcaaugacuuugagaccggacagaacacaagauucacgcccgugggcguugugcaagauggcuccaccacacaccagaaugaaccccagcaguggguccucccugacuacagcgggcgggauaaccacaaugugcaucuggcuccggccguggcccccaccuuuccuggagagcaacuucuguucuuucgcucuacaaugcccggcuguuccggguacccuaacaugaaucucgacugccugcugccccaggaauggguucagcacuucuaucaggagagcgcuccugcccaaucugaugucgcgcuccugagauuugugaaccccgacaccggacgggugcuuuucgaguguaagcugcauaaaagcggcuacgucacgguggcucacaccgggcagcacgaucucguuaucccgccuaacggcuauuuuagauucgacuccugggugaaucaguucuacacacuggcccccaugggaaacggcgccgggcgccggagauga

SEQ ID NO: 29235 - RNA, 1617 nt, Artificial Sequence
  derived and/or modified sequence opt5 from VP1__Norovirus_and/or_Norovirus-like__AB663687
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucggaacagacaccgagaacgauuuugaaacccaucaaaauacaaaguucaccccugugggcgucauucaggacggcucuacaacgcaccgcaacgagccccagcaaugggugcugcccagcuacuccgggagaaauguucacaacgugcaucuugccccugcugucgccccgaauuuucccggagaacaguuccuguuuuuccggagcaccaugccuggcuguucuggguaucccaacauggaucucgacugccugcugccucaggagugggugcagcacuuuuaccaagaggcggcucccgcccaguccgauguggcccuccugcgcuucguuaacccugacacaggaagaguccuuuuugaauguaaacugcauaagagcggcuaugugaccguggcucacacagggcagcacgaucucgucauucccccgaauggcuacuuccgguucgacucuugggugaaccaguuuuauacccuggccccuaugggaaauggcacggggagacgccgguga

SEQ ID NO: 29236 - RNA, 1617 nt, Artificial Sequence
  derived and/or modified sequence opt5 from VP1__Norovirus_and/or_Norovirus-like__AB933759
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggagauacagcccaucggaaugagccccaacagugggugcucccuucuuacagcggccgcaacucccacaauguucaccuggcgccggcuguggcccccacguuuccuggcgaacagcuucuguucuuuagaagcaccaugcccggguguucuggauauccuaacauggaccucgauugccugcugccccaggaguggguccaauacuucuaucaggaagccgcuccugcccaguccgacguggcucuccugcgguuugugaaucccgauacaggcagaguucuuuucgaguguaagcugcauaaaagcggguacgucaccguggcccacacaggacagcaugaccucgugaucccgccuaacggcuauuuucgcuucgacucuugggucaaccaauucuacacccuggcgcccauggggaauggcacgggacggagacgcuga

SEQ ID NO: 29237 - RNA, 1617 nt, Artificial Sequence
  derived and/or modified sequence opt5 from VP1__Norovirus_and/or_Norovirus-like__AB933755
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucuccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccgggccuuccagcacauucgucgugcagccccagaacggacgguguaccacggauggcguucuccuggggacaacccaacugucuccugugaauaucugcacauuucgcggagacgucacccauaucaccggcucccacaacuacacaaugaaucucgcuagccagaacuggaacuccuaugaucccacggaggaaauuccugcuccccugggcaccccggacuucguggggaaaauccagggaguccuuacacagaccacaagaaccgacggcucuacgcgggggcauaaggccacaguguacaccggaagcgccgaguuuuccccuaagcugggccgcguucaauucgcgaccgauacaaauaaugacuuugaugccaaccagaauaccaaauucacacccgugggggucauucaggacggaggcacgacccacagaaacgaaccccaacagugggugcucccuagcuacucuggccggaauacacacaacguucaucuggcuccggccguggcccccaccuuuccuggggagcagcuucuguucuuucgcuccacaaugcccggauguagcggcuauccuaauauggaucucgacugccugcugccccaggaauggguccaacacuucuaccaggaggcugccccugcgcagucugauguggcucuccugagauuugugaaccccgacaccgggcggguucuuuucgaguguaagcugcauaaaagcggauaugucacgguggcccacaccggccagcacgaucucgugaucccgccuaacggguacuuuagauucgacuccugggucaaucaauucuauacacuggcccccaugggcaacggaaccggccgccggagauga

SEQ ID NO: 29238 - RNA, 1617 nt, Artificial Sequence
  derived and/or modified sequence opt5 from VP1__Norovirus_and/or_Norovirus-like__AB933677
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaagauguuuucaccguguccugcagagugcugacacggcccagcccugacuuugauuucaucuuucucgucccgcccaccguggagucucgcacaaaaccuuucaccguucccauucugacgguggaagagaugaccaacuccagauuuccuaucccccuugagaagcuguucacagggccgagcucugccuucgucgugcagccucagaauggacgguguaccacagacggcguucuccuggggaccacgcaacugucccccgugaacaucugcacauuucgcggagaugucacccauauugcuagcucuagaaauuacacaaugaaccucgcgucccugaauuggaacaauuaugacccuaccgaagagauccccgccccucuuggcacccccgauuucgugggcaaaauucaggggguccugacacagacgaccaagggagacggcagcacacgggggcacaaggcuaccguguacacaggauccgccccguuuaccccuaaacucggcucuguucaguucagcacggacacagaaaacgauuuugagacccaucaaaauaccaaguucacacccgugggggucauccaggacggaggcaccacacaccgcaacgaaccccagcaaugggugcugccuuccuacagcggcagaaauguuccgaacgugcaccuugcccccgcugucgccccuacguuucccggggagcagcuccuguucuuucggucuaccaugccuggauguuccggcuaucccaauauggaucuggacugccugcucccucaggagugggugcagcauuucuaccaagaagcggcucccgcccagagcgauguggcccugcuucgcuuuguuaacccggacacagggagaguccuguucgaguguaaacuccacaagucuggauaugugaccguggcucauacaggccagcacgaucuggucauuccucccaacggguacuuucgguucgacagcugggugaaucaguucuauacccuugccccuaugggcaacggaacgggcagacgccgguga

SEQ ID NO: 29239 - RNA, 1617 nt, Artificial Sequence
  derived and/or modified sequence opt5 from VP1__Norovirus_and/or_Norovirus-like__AB933650
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacgggguccgccccguuuacaccuaaacucggaagcguucaguucuccaccgacaccgaaaacgauuuugaggcccaucagaauacaaaguucacccccgugggcgucauucaagacggcucuacaacgcaccgcaacgaaccccagcagugggugcugccuagcuacuccgggagaaauguucaaaacgugcaccuugcuccggccgucgcgcccaccuuuccuggagagcagcuccuguucuuucggagcacaaugcccggcuguucuggguauccuaauauggaucuggacugccugcucccccaggagugggugcagcauuucuaccaagaagcugccccugcccaguccgauguggcucugcuucgcuuuguuaaccccgacaccggaagaguccuguucgaguguaaacuccacaagagcggcuaugugacaguggcccauaccgggcagcacgaucuggucaucccgccuaacggcuacuuucgguucgacucuugggugaaucaguucuauacgcuugcucccaugggaaacggcaccgggagacgccgguga

SEQ ID NO: 29240 - RNA, 1617 nt, Artificial Sequence
  derived and/or modified sequence opt5 from VP1__Norovirus_and/or_Norovirus-like__KM245071
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcugacuuuacgccgaaacucgggagcguucaguucuccacagauaccgaaaaugacuuugagacccaucaaaacacaaaguucaccccugugggagucauucaggauggcucuacaacgcaccgcaaugaaccccagcaaugggugcugcccagcuacuccggcagaaacguucacaaugugcaucuugccccugcggucgcuccgaccuuucccggggagcagcuccuguucuuucggagcacaaugccuggauguucuggcuaucccaacauggaccuggauugccugcucccucaggagugggugcagcacuucuaccaagaagccgcccccgcucaguccgacguggcccugcuucgcuuuguuaauccugauaccgggagaguccuguucgaguguaaacuccauaagagcggauaugugacaguggcucacaccggccagcacgaccuggucauucccccgaacggguacuuucgguucgauucuugggugaaccaguucuauacgcuugccccuaugggcaauggaaccggcagacgccgguga

SEQ ID NO: 29241 - RNA, 1617 nt, Artificial Sequence
  derived and/or modified sequence opt5 from VP1__Norovirus_and/or_Norovirus-like__KF712497
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagauccaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucaguccaacgacagcacaauuaagcucaucgccaugcuguauacaccccuucgcgcuaauaacgccggcgaugacguuuucaccgugucuugcagagugcugacccggcccuccccugauuuugacuucauuuuucucgucccgcccacaguggaaagccgcaccaaaccuuucacgguucccauccugaccguggaggaaaugacaaacucuagauuuccuauuccccuugagaagcuguucaccgggccguccagcgccuucgucgugcagccucagaauggacgguguacaaccgauggcguucuccuggggacgacacaacugucucccgugaacaucugcaccuuucgcggagacgucacacauaucgcuggcuccagaaauuacaccaugaaccucgcgagccugaauugguccaacuaugauccuaccgaggaaauucccgccccucuuggcacacccgacuucguggggaaaauccagggaguccugacgcagaccacaaagggcgacgggucuacccggggacacaaggcuacaguguacaccggcagcgccgauuuuacgccgaaacucggguccauucaguucgccacagacaccgagaaugauuuugaaacccaucaaaacacacgcuucaccccuguuggagugauccaggacggcggcacaacgcacagaaaugagccccagcaauggguccugcccagcuacucugggcggaacgugcacaauguucaucuugcuccugccguggcgccgaacuuucccggagaacagcuccuguucuuucgcuccaccaugccuggcuguagcggguaucccaauauggaucuggacugccugcucccucaggaguggguccagcacuucuaccaagaggcugcccccgcccagucugauguggcucugcuuagauuugugaacccugacacaggacggguucuguucgaauguaagcuccauaaaagcggcuaugucaccguggcccacacagggcagcacgaucuggugauucccccgaauggcuacuuuagauucgacuccugggucaaccaguucuauacccuugcuccuaugggaaacggcacggggcgccggagauga

SEQ ID NO: 29242 - RNA, 1617 nt, Artificial Sequence
  derived and/or modified sequence opt5 from VP1__Norovirus_and/or_Norovirus-like__KC990829
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucgccacagacaccgagaacgauuuugaaacccaucaaaauacaaaguucaccccugugggagucauucaggacggcucuacaacgcaccgcaacgagccccagcaaugggugcugcccagcuacuccggcagaaauguucacaacgugcaucuugcuccugccgucgcgccgaauuuucccggggaacagcuccuguucuuucggagcaccaugccuggauguucuggcuaucccaacacagaucuggacugccugcucccucaggagugggugcagcacuucuaccaagaggcugcccccgcccaguccgauguggcucugcuucgcuuuguuaacccugacaccgggagaguccuguucgaauguaaacuccauaagagcggauaugugacaguggcccacaccggccagcacgaucuggucauucccccgaauggguacuuucgguucgacucuugggugaaccaguucuauacgcuugcuccuaugggcaauggaaccggcagacgccgguga

SEQ ID NO: 29243 - RNA, 1617 nt, Artificial Sequence
  derived and/or modified sequence opt5 from VP1__Norovirus_and/or_Norovirus-like__JX439843
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugcccccugugaauaucugcaccuuucgcggagaugucacacauaucgcuggcagcagaguguacaccaugaaccucgcgucucugaauuggaacaauuaugaccccaccgaagagauuccugcuccccuuggcacaccggauuucgucgggaaaauccagggagugcugacgcagaccacaaaggaagacggcuccacccgggggcacaaggccacaguuuacaccggaagcgccccuuuuacgcccaaacucggcuccgugcaguucucuacagacaccgagaacgauuuugaaacccaucaaaauacaaaguucacccccgucggggugauucaggacggaggcacaacgcaccgcaacgagccucagcaauggguucugccgagcuacuccggcagaaaugcccccaacgugcaccuugcuccugccgucgcgcccaccuuuccuggggagcagcuccuguucuuucggagcacaaugcccggauguucuggcuauccuaauauggaucuggacugccugcucccccaggaaugggugcagcauuucuaccaagaggcugccccggcccaguccgauguggcucugcuucgcuuuguuaacccugacaccgggagaguccuguucgaauguaaacuccacaagagcggauaugugacaguggcccauaccggccagcacgaucuggucauucccccuaauggguacuuucgguucgacucuugggugaaccaguucuauacgcuugcucccaugggcaacggaaccggcagacgccgguga

SEQ ID NO: 29244 - RNA, 1617 nt, Artificial Sequence
  derived and/or modified sequence opt5 from VP1__Norovirus_and/or_Norovirus-like__JX439841
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagagacuacaccaugaaccucgcgucccugaauuggaacaauuaugauccuaccgaagagauucccgccccucuuggcacacccgacuucguggggaaaauccagggaguccugacgcagaccacaaagggcgacgggagcacccggggacacaaggcuacaguguacaccggcuccacgccguuuacaccuaaacucgggucuguucaguucagcaccgauaccgaaaacgacuuugagacacaucaaaauaccaaguucacacccgugggagucauucaggauggcggcacgacccaccgcaacgaaccccagcaaugggugcugccuuccuacagcgggagaaauguucagaacgugcaccuugccccggccgucgcucccacauuuccuggagagcagcuccuguucuuucggucuaccaugcccggcuguuccggguauccuaauauggaccuggauugccugcucccccaggagugggugcaacauuucuaccaggaagccgcgccugcucagagcgacguggcccugcuucgcuuuguuaaccccgauacaggaagaguccuguucgaguguaaacuccacaagucuggcuaugugaccguggcccauacggggcagcacgaccuggucaucccgccuaauggcuacuuucgguucgauagcugggugaaccaauucuauacccuugcucccaugggaaacggcacagggagacgccgguga

SEQ ID NO: 29245 - RNA, 1617 nt, Artificial Sequence
  derived and/or modified sequence opt5 from VP1__Norovirus_and/or_Norovirus-like__JX439830
augaagaugggcagcaacgacgccaaucccuccgaugggucuaccgcuaaccuggugccugaggucaauaacgaaguuauggcccucgagccgguggugggagcggcuaucgccgcccccgucgcuggccagcaaaaugugauugacccuuggaucagaaacaauuucguucaggcccccgggggagaauuuacagugagcccucggaacgcucccggcgagauucugugguccgccccucuugggccggaucugaaucccuaccucucucaccuggcgcgcauguauaacggauacgccggcggcuucgaaguccaggugauccuugcugggaaugccuuuacggcuggaaaaauuaucuucgccgcgguuccucccaacuuuccuaccgagggccugagccccucccaggugacaauguucccgcauaucauugucgacgugagacaacucgagccugugcugaucccccugccugauguccggaauaacuuuuaucacuacaaucagucuaacgaccccaccauuaagcucaucgccaugcuguauacaccccuucgcgcuaacaaugccggggaugacguuuucaccgugagcugcagagugcugacacggccuuccccggauuuugacuucauuuuucucgugcccccuaccgucgaaagccgcacgaaacccuucucuguuccuauccugaccguggaggaaaugacaaacuccagauuucccauuccgcuugagaagcuguucaccggaccuagcucugcuuucgucgugcagccccagaauggccgguguacaaccgaugggguucuccugggaacgacacaacuguccccugugaacaucugcaccuuucgcggcgacgucacacauaucaccggcagcagaaauuacaccaugaaccucgccacacagaauuggaacucuuaugaucccacggaggaaauuccugcuccccuggggaccccggacuucgugggaaaaauccagggcguccuuacacagaccacacgggccgacggguccacccgcggacacaaggcgacgguguacacaggcagcgccgauuuugcuccuaagcuggggagaguucaauucgccaccgacaccgauaaugacuuugaugccaaccagaauacaaaauucacccccgugggagucauucaggacggcgauacagcucaucggaacgagccccaacagugggugcucccuuccuacucuggccgcaauagccacaacguucaccuggccccggcgguggcucccacguuuccuggggaacagcuucuguucuuuagauccaccaugcccggauguagcggcuauccuaauauggaccucgauugccugcugccccaggaguggguccaauacuucuaucaggaagccgccccugcucagucugacguggcccuccugcgguuugugaaccccgauacagggagaguucuuuucgaguguaagcugcauaaauccggauacgucaccguggcucacacaggccagcaugaccucgugaucccgccuaacggguauuuucgcuucgacagcugggucaaucaauucuacacccuggcccccaugggcaacggaacgggccggagacgcuga

SEQ ID NO: 29246 - RNA, 1617 nt, Artificial Sequence
  derived and/or modified sequence opt5 from VP1__Norovirus_and/or_Norovirus-like__JX439828
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugguucuugccggcaacgcuuuuacggccgggaaaaucauuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuauucugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucaccggcucuagaaacuacaccaugaaucucgccacacagaacuggaacuccuaugaucccacggaggaaaucccugcuccccugggcaccccggacuucgucgggaaaauucagggagugcuuacacagaccacacgggcggacggcagcacccgcgggcacaaggccacgguuuacacaggauccgcugauuuugccccuaagcugggcagagugcaauucgccaccgacaccgauaaugacuuugaugcuaaucagaacacaaaauucacccccgucggggugauccaggacggagauacagcccaucggaaugagccccaacaguggguucucccuucuuacagcggccgcaacucccacaaugugcaccuggcgccggcugucgcccccacguuuccuggcgaacagcuucuguucuuuagaagcaccaugcccggguguucuggauauccuaacauggaccucgauugccugcugccccaggagugggugcaauacuucuaucaggaagccgcuccugcccaguccgacguggcucuccugcgguuuguuaaucccgauacaggcagaguccuuuucgaguguaagcugcauaaaagcggguacgugaccguggcccacacaggacagcaugaccucgucauuccgccuaacggcuauuuucgcuucgacucuugggugaaccaauucuacacccuggcgcccauggggaauggcacgggacggagacgcuga

SEQ ID NO: 29247 - RNA, 1617 nt, Artificial Sequence
  derived and/or modified sequence opt5 from VP1__Norovirus_and/or_Norovirus-like__JX445153
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcgccccggacuucguggggaaaauccagggaguccuuacccaaacaaccagaggcgacgggucuacacggggacacaaggcuaccguguccacgggcagcguucauuuuacaccuaagcugggguccgugcaguucucuaccgauaccagcaaugaccucgagacaggacagaacacccgcuuuacacccgucggcgugguucaagauggcuccacgacccaccagaaugaaccccagcagugggugcugccuaacuacagcgggagagacucucacaauguccaucuugccccggccguggcucccacauucccuggagagcaacugcucuuuuuccgguccaccaugcccggcuguagcggguacccuaacaugaaucuggauugccugcucccccaggaaugggugcagcacuuuuaucaggagucugccccugcgcaaagcgacguugcucugcuucgcuucgucaaccccgauacaggaagagugcuguuugaguguaaacuccauaaguccggcuacgugaccgucgcccacacggggcagcacgaccuggugauuccgccuaacggcuauuuccgguuugauucuuggguuaaucaguucuacacccuugcccccaugggaaacggcgcugggagacgccgguga

SEQ ID NO: 29248 - RNA, 1617 nt, Artificial Sequence
  derived and/or modified sequence opt5 from VP1__Norovirus_and/or_Norovirus-like__JX155754
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgaccccacaauuaagcucaucgccaugcuguauacaccccuucgcgcuaacaaugccggcgaagauguuuucaccgugagcugcagagugcugacccggccuuccccggacuuugauuucauuuuucucgugcccccuacagucgagagccgcaccaaacccuucacgguuccuauccugaccguggaagagaugacaaacucuagauuucccauuccgcuugagaagcuguucaccgggccuuccagcgccuucgucgugcagccccagaauggacgguguacaaccgacggcguucuccuggggacgacacaacugucuccugugaacaucugcaccuuucgcggagaugucacacauaucgcuggcuccagaaauuacaccaugaaccucgcgagccugaauuggaacaauuaugaccccaccgaagagauuccugcuccccuuggcacaccggauuucguggggaaaauccagggaguccugacgcagaccacaaagggcgacgggucuacccggggacacaaggccacaguguacaccggcuccgccccuuuuacgcccaaacucgggagcguucaguucuccacagacaccgaaaacgauuuugagacccaucaaaauacaaaguucacccccgugggagucauucaggacggcggcacaacgcaccgcaacgaaccucagcaaugggugcugccgucuuacagcgggagagauguucccaaugcccaccuugcuccugccguggcgcccaccuuuccuggagagcagcuccuguucuuucgguccacaaugcccggcuguagcggguauccuaacauggaccuggauugccugcucccccaggaguggguccagcauuucuaccaagaagcugccccggcccagucugacguggcucugcuucgcuuugugaauccugauaccggaagaguucuguucgaguguaaacuccacaaguccggcuaugucacaguggcccauaccgggcagcacgaccuggugauucccccuaacggcuacuuucgguucgauagcugggucaaccaguucuauacgcuugcucccaugggaaauggcaccgggagacgccgguga

SEQ ID NO: 29249 - RNA, 1617 nt, Artificial Sequence
  derived and/or modified sequence opt5 from VP1__Norovirus_and/or_Norovirus-like__JN400608
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagccacaauuacaccaugaaccucgcgucucugaauuggaacaauuaugacccuaccgaagagauucccgccccucuuggcacacccgauuucguggggaaaauccagggaguccugacgcagaccacaaagggcgacggguccaccagaggacauaaggcuacaguguacaccggcagcgccccguuuacgccuaaacucggguccguucaguucucuacagacaccgaaaacgauuuugagacccaccaaaauacaaaguucacccccgugggagucauucaggacggcagcacaacgcaccggaacgaaccccagcaaugggugcugccuuccuacagcggcgggaauguucauaacgugcaccuugccccggcugucgcccccaccuuuccuggagagcagcuccuguucuuucgcucuacaaugcccggcuguuccggguauccuaauauggaucuggacugccugcucccccaggagugggugcagcauuucuaccaagaagcggcuccugcccagagcgauguggcccugcuuagauuuguuaaccccgacaccggacggguccuguucgaguguaaacuccacaagucuggcuaugugacaguggcucacaccgggcagcaugaucuggucaucccgccuaacggcuacuuucgcuucgacagcugggugaaucaguucuauacgcuugcccccaugggaaacggcaccgggagacggagauga

SEQ ID NO: 29250 - RNA, 1617 nt, Artificial Sequence
  derived and/or modified sequence opt5 from VP1__Norovirus_and/or_Norovirus-like__EF187497
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuguuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaagauguguucaccguguccugcagaguccugacacggccuagcccggacuuugauuucaucuuucucgugcccccuaccguugagucucgcacgaaacccuucuccgugccuauucugaccgucgaagagaugacaaauagcagauuucccaucccgcuugagaagcuguucaccgggccuucuuccacaauugugguucagccccagaacggacgguguaccacggacggcgugcuccuggggacaacccaacugagcccugucaauaucugcacauuccgcggagaugugacccauaucgccggcacccaggaauacacaaugaaccucgccucucagaauuggaacaauuaugaccccacggaggaaauuccugcuccccugggcaccccggauuuugucgggaaaauccagggagugcuuacacaaaccacaagacgggacggcuccacccgcgggcacaaggcgacgguuagcacaggauccgugaacuucaccccuaagcugggccggauucaguuuucuaccgacacaagcaaugauuucgagaccgggcaguccacaagauuuacgcccgucggagugguucaagacggcagcaccacacaucagaacgaaccccagcagugggugcucccugauuacucuggccgcgacucccacaauguccaccuggccccggcuguggcccccagcuucccuggggagcaacuucuguuuuucagaucuaccaugcccggauguagcggcuacccuaacaugaaucucgauugccugcugccccaggagugggugcagcauuuuuaucaggaagccgcuccugcccaauccgacguugcgcuccugcgguucgucaaccccgauacagggagagugcuuuuugaguguaaacugcacaagucuggauacgugaccgucgcucauacgggccagcacgaccucgugaucccgccuaauggguauuuccgcuuugauagcuggguuaaccaguucuacacccuggcccccaugggcaacggaacaggccggagacgcuga

SEQ ID NO: 29251 - RNA, 1617 nt, Artificial Sequence
  derived and/or modified sequence opt5 from VP1__Norovirus_and/or_Norovirus-like__AB668028
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcuccacaacgcaccgcaaugaaccccagcaaugggugcugccuagcuacucuggcagaaacguucacaaugugcaucuugccccggcugucgcccccaccuuuccuggggagcagcuccuguucuuucgguccacaaugcccggauguagcggcuauccuaacauggaucuggacugccugcucccccaggagugggugcagcacuucuaccaagaagcggcuccugcccagucugauguggcccugcuucgcuuuguuaaucccgacaccgggagaguccuguucgaguguaaacuccauaagagcggauaugugacaguggcucacaccggccagcacgaucuggucaucccgccuaacggguacuuucgguucgacuccugggugaaccaguucuauacgcuugcccccaugggcaauggaaccggcagacgccgguga

SEQ ID NO: 29252 - RNA, 1617 nt, Artificial Sequence
  derived and/or modified sequence opt5 from VP1__Norovirus_and/or_Norovirus-like__HM802542
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggagaauccagggaguccuuacacaaaccacacggcgcgacggcucuaccagagggcacaaagccacgguguccacaggaagcguucauuuuaccccuaagcugggcuccgugcaguucucuaccgauacaagcaaugacuuugagaccgggcagaacacacgguucacgcccgucggagugguucaagauggcuccaccacacaccagaaugaaccccagcagugggugcucccugacuacagcggccgcgauucucacaacguccaucuggcuccggccguggcccccaccuuuccuggggagcaacuucuguucuuuagauccacaaugcccggauguagcggcuacccuaauaugaaccucgacugccugcugccccaggaaugggugcagcacuucuaucaggagucugcuccugcccaaagcgauguugcgcuccugcgguuugucaaucccgacaccgggagagugcuuuucgaguguaagcugcauaaauccggauacgugacggucgcucacaccggccagcacgaucucgugauuccgccuaacggguauuuucgcuucgacucuuggguuaaccaguucuacacacuggcccccaugggcaauggagccggccggagacgcuga

SEQ ID NO: 29253 - RNA, 1617 nt, Artificial Sequence
  derived and/or modified sequence opt5 from VP1__Norovirus_and/or_Norovirus-like__HQ009513
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccuauccugaccguggaggaaaugacaaacuccagauuucccauuccgcuugagaagcuguucaccgggccuagcucugccuucgucgugcagccccagaauggacgguguacaaccgauggcguucuccuggggacgacacaacuguccccugugaacaucugcaccuuucgcggagacgucacacauaucaccggcagcagaaauuacaccaugaaccucgccacacagaauuggaacucuuaugaucccacggaggaaauuccugcuccccugggcaccccggacuucguggggaaaauccagggaguccuuacacagaccacacgggcggacggcuccacccgcgggcacaaggccacgguguacacaggaagcgcugauuuugccccuaagcugggcagaguucaauucgccaccgacaccgauaaugacuuugaugcuaaccagaauacaaaauucacccccgugggggucauucaggacggaaacacagcccaucggaaugagccccaacagugggugcucccuuccuacucuggccgcaacagccacaauguucaccuggcgccggcuguggcccccacguuuccuggcgaacagcuucuguucuuuagauccaccaugcccggguguagcggauauccuaacauggaucucgacugccugcugccccaggaguggguccaauacuucuaucaggaagccgcuccugcccagucugauguggcucuccugcgguuugugaaccccgacacaggcagaguucuuuucgaguguaagcugcauaaauccggguacgucaccguggcccacacaggacagcaugaucucgugaucccgccuaauggcuauuuucgcuucgacagcugggucaaccaauucuacacccuggcgcccauggggaauggcacgggacggagacgcuga

SEQ ID NO: 29254 - RNA, 1617 nt, Artificial Sequence
  derived and/or modified sequence opt5 from VP1__Norovirus_and/or_Norovirus-like__AB541322
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggagauacagcccaucggaaugagccccaacagugggugcucccuucuuacagcggccgcaacucccacaauguucaccuggcgccgacgguggcucccaccuuuccuggcgaacagcuucuguucuuuagaagcacaaugcccggguguucuggauauccuaacauggaccucgauugccugcugccccaggaguggguccaauacuucuaucaggaagccgccccugcucaguccgacguggcccuccugcgguuugugaaucccgauaccggcagaguucuuuucgaguguaagcugcauaaaagcggguacgucacaguggcucacaccggacagcaugaccucgugaucccgccuaacggcuauuuucgcuucgacucuugggucaaccaauucuacacgcuggcccccauggggaauggcaccggacggagacgcuga

SEQ ID NO: 29255 - RNA, 1617 nt, Artificial Sequence
  derived and/or modified sequence opt5 from VP1__Norovirus_and/or_Norovirus-like__AB541321
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucagaacgcccccuccgagauucuguggucugcgccucuuggaccggaucugaaucccuaccucagccaccuggcccggauguauaacggcuacgcugggggauucgaaguccaggugauccuugccggcaaugcuuuuacggccggcaaaauuaucuucgcggccguuccucccaacuuuccuaccgaggggcugucccccucucaagugacaauguucccgcauaucauugucgacgugcgccagcucgagccugugcugaucccccugccugaugucagaaauaacuuuuaucacuacaaucagagcaacgaccccaccauuaagcucaucgcuaugcuguauacaccccuucgggccaacaaugcuggagaugacguuuucaccguguccugccgcgugcugacaagaccuagcccggauuuugacuucauuuuucucgugcccccuaccgucgaaucucggacgaaacccuucaccguuccuauccugacaguggaggaaaugaccaacucccgcuuucccauuccgcuugagagacuguacacaggcccuagcucugccuucgucgugcagccccaaaaugggcgguguaccacggauggaguucuccugggcacaacccagcuguccgccgugaacaucugcacauuccgcggggacgucacccauaucgcuggaagcagaaauuauaccaugaaccucgcgucucagaauuggaacaauuacgauccuacagaggaaauucccgccccucugggcacgcccgacuuugugggcaagauccaggggaugcuuacccaaacaacccgguccgacggaagcacacgcggccacaaagcuaccguccugacgggguccgccgauuucgccccgaagcucggaagagugcaguuugcuacagacaccgauaacgacuucgagucuggccagaauaccaaguuuacaccuguuggggugauucaagauggaagcaccacacaucggaacgaaccccagcaguggguccugcccaauuacuccggccgcacgggccacaacgugcaccuugccccugcgguugcuccgaccuaucccggggagcagcuccuguucuuuagaagcacaaugccuggauguucuggcuaccccaauauggaccuggauugccugcucccucaagaaugggugcagcauuucuaucaggaggccgcccccgcucaguccgacgucgcccugcuucgguuugugaacccugauaccgggagagugcuguucgaguguaaacuccacaagagcggauacguuacagucgcucauaccggccaacacgaccuggugauucccccgaacggguauuuucgcuucgauucuugggugaaucaguuuuacacgcuugccccuaugggcaacggaaccggccggagacgcuga

SEQ ID NO: 29256 - RNA, 1617 nt, Artificial Sequence
  derived and/or modified sequence opt5 from VP1__Norovirus_and/or_Norovirus-like__AB541253
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgagaacgacuuugaaacccaucaaaauacaaaguucacccccgugggagucauucaggauggcagcacaacgcaccgcaacgagccccagcaaugggugcugccuuccuacagcggcagaaauguucacaacgugcaucuugccccggcugucgcccccaccuuuccuggggaacagcuccuguucuuucggucuacaaugcccggauguuccggcuauccuaauauggaccuggauugccugcucccccaggagugggugcagcacuucuaccaagaggcggcuccugcccagagcgacguggcccugcuucgcuuuguuaaccccgauaccgggagaguccuguucgaauguaaacuccauaagucuggauaugugacaguggcucacaccggccagcacgaccuggucaucccgccuaacggguacuuucgguucgauagcugggugaaucaguucuauacgcuugcccccaugggcaacggaaccggcagacgccgguga

SEQ ID NO: 29257 - RNA, 1617 nt, Artificial Sequence
  derived and/or modified sequence opt5 from VP1__Norovirus_and/or_Norovirus-like__AB541250
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaagacacaaaguucacccccgugggagucauucaggauggcggcacaacgcaccgcaacgaaccccagcaaugggugcugccuuccuacagcgggagaaauguucagaacgugcaccuugccccggcugucgcccccaccuuuccuggagagcagcuccuguucuuucggucuacaaugcccggcuguuccggguauccuaauauggaccuggauugccugcucccccaggagugggugcaacauuucuaccaggaagcggcuccugcccagagcgacguggcccugcuucgcuuuguuaaccccgauaccggaagaguccuguucgaguguaaacuccacaagucuggcuaugugacaguggcucauaccgggcagcacgaccuggucaucccgccuaauggcuacuuucgguucgauagcugggugaaccaauucuauacgcuugcccccaugggaaacggcaccgggagacgccgguga

SEQ ID NO: 29258 - RNA, 1617 nt, Artificial Sequence
  derived and/or modified sequence opt5 from VP1__Norovirus_and/or_Norovirus-like__AB541211
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacauuaugaaccucgcgucucugaauuggaacaauuaugacccuaccgaagagauccccgccccucuuggcacccccgauuucguggggaaaauucagggaguccugacacagacgaccaagggcgacggguccacacggggacacaaggcuaccguguacacaggcagcgccccguuuaccccuaaacucggguccguucaguucucuacggacacagaaaacgauuuugagacccaucaaaauaccaaguucacacccgugggagucauccaggacggcagcaccacacaccgcaacgaaccccagcaaugggugcugccuuccuacagcggcagaaauguucacaacgugcaucuugccccggcugucgcccccacguuuccuggggagcagcuccuguucuuucggucuaccaugcccggauguuccggcuauccuaauauggaucuggacugccugcucccccaggagugggugcagcacuucuaccaagaagcggcuccugcccagagcgauguggcccugcuucgcuuuguuaaccccgacacagggagaguccuguucgaguguaaacuccauaagucuggauaugugaccguggcucacacaggccagcacgaucuggucauuccgccuaacggguacuuucgguucgacagcugggugaaucaguucuauacccuugcccccaugggcaacggaacgggcagacgccgguga

SEQ ID NO: 29259 - RNA, 1617 nt, Artificial Sequence
  derived and/or modified sequence opt5 from VP1__Norovirus_and/or_Norovirus-like__GQ246797
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucuagaaacuacaccaugaaucucgcuacccagaacuggaacuccuaugaucccacagaggaaauuccugcgccccugggcacgccggacuucguggggaaaauccagggaguccuuacccagacaacccgggccgacggcagcacacgcgggcacaaggcuaccguguacacgggauccgccgauuuugccccuaagcugggcagaguucaauucgcuacagacaccgauaaugacuuugaugccaaucagaacaccaaauucacacccgugggggucauucaggacggagauaccgcgcaucggaaugagccccaacagugggugcucccuucuuacagcggccgcaacucccacaauguucaccuggcuccggccguggcccccacauuuccuggcgaacagcuucuguucuuuagaagcacgaugcccggguguucuggauauccuaacauggaccucgauugccugcugccccaggaguggguccaauacuucuaucaggaagcugccccugcucaguccgacguggcccuccugcgguuugugaaucccgauaccggcagaguucuuuucgaguguaagcugcauaaaagcggguacgucacaguggcgcacaccggacagcaugaccucgugaucccgccuaacggcuauuuucgcuucgacucuugggucaaccaauucuacacacuggcccccauggggaauggcaccggacggagacgcuga

SEQ ID NO: 29260 - RNA, 1617 nt, Artificial Sequence
  derived and/or modified sequence opt5 from VP1__Norovirus_and/or_Norovirus-like__GQ246794
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauuccuuggucugcgccgcugggccccgaucuuaacccuuaccugagccaccucgcccgcauguauaauggguacgcuggaggcuucgaaguccaggugauccuggccggcaacgcuuuuacggccgggaaaauuaucuucgcggccguucccccuaauuuucccaccgagggacuuuccccgucucaggugacaauguucccucauaucauugucgacgugagacaacuggagcccgugcucaucccucugcccgauguccggaacaauuuuuaucacuacaaccagagcaaugaccccaccauuaagcugaucgcuaugcucuauacaccucugcgcgccaacaacgcuggcgaugacguuuucaccguguccugcagagugcuuacacggccgagccccgauuuugacuucauuuuucuggucccucccaccguggaaucucgcacgaaaccuuucuccguucccauccucaccguggaggaaaugacaaauagcagauuuccgauuccucuggagaaacuuuucaccgggcccucuuccgccuucgucgugcagccucagaacggacgguguacaaccgauggcguucugcucgggacgacacaacugagccccgugaauaucugcaccuuucgcggagacgucacacauaucaccggcucuagaaacuacaccaugaaucuggccacacagaacuggaacuccuaugauccuacggaggaaauucccgcuccgcucggcaccccugacuucguggggaagauccagggaguccugacacagaccacacgggcggacggcagcacccgcgggcacaaggccacgguguacacaggauccgcugauuuugcccccaaacuuggcagaguucaauucgccaccgacaccgauaaugacuuugaugcuaaucagaacacaaaguucacccccgugggggucauucaggacggagauacagcccaucggaaugagccucaacagugggugcugccgucuuacagcggccgcaacucccacaauguucaccucgcgcccgcuguggccccuacguuucccggcgaacagcugcuuuucuuuagaagcaccaugccuggguguucuggauaucccaacauggaccuggauugccuccugccucaggaguggguccaauacuucuaucaggaagccgcucccgcccaguccgacguggcucugcuccgguuugugaauccggauacaggcagaguucuguucgaguguaaacuucauaagagcggguacgucaccguggcccacacaggacagcaugaccuggugaucccucccaacggcuauuuucgcuucgacucuugggucaaccaauucuacacccucgcgccuauggggaauggcacgggacggagacgcuga

SEQ ID NO: 29261 - RNA, 1617 nt, Artificial Sequence
  derived and/or modified sequence opt5 from VP1__Norovirus_and/or_Norovirus-like__EU876884
augaagauggccagcaacgacgcuaaucccuccgauggcucuaccgccaaccuggugccugaggucaauagcgaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucaccguuccuauccugacaguggaggaaaugaccaauuccagauuucccauuccgcuugagcggcuguacacagggccuagcucugccuucgucgugcagccccagaacggacgcuguaccacggauggcguucuccuggggacaacccaacuguccgccgugaauaucugcacauucagaggagacgucacccauaucgcuggcagccggaacuauaccaugaaucucgcgucucagaacuggaauaacuacgauccuacagaggaaauucccgccccucugggcacgcccgacuuuguggggaagauccagggaaugcuuacccagacaacccgcuccgacggcagcacaagagggcacaaagcuaccguccugacgggauccgccgauuucgccccgaagcucggccgggugcaauuugcuacagacaccgauaaugacuucgagucugggcagaacaccaaguuuacaccuguuggagugauucaggauggcagcaccacacaucgcaaugaaccccaacaguggguccugcccuccuacagcggcagaacggggcacaacgugcaccuugccccugcgguugcuccgaccuaucccggagagcagcuccuguucuuucggucuacaaugccuggcuguuccggguaccccaauauggaccuggauugccugcucccucaggaaugggugcaacauuucuaucaggaggccgcccccgcucagagcgacgucgcccugcuuagauuugugaacccugauaccggacgcgugcuguucgaguguaaacuccacaagucuggcuacguuacagucgcucauaccgggcagcacgaccuggugauucccccgaauggcuauuuucgguucgauagcugggugaaccaauuuuacacgcuugccccuaugggaaacggcgcggggagacgccgguga

SEQ ID NO: 29262 - RNA, 1617 nt, Artificial Sequence
  derived and/or modified sequence opt5 from VP1__Norovirus_and/or_Norovirus-like__FJ411170
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaagauguuuucaccguguccugcagagugcugacacggccuagcccggacuuugauuucauuuuucucgugcccccuaccgucgagucucgcacgaaacccuucaccguuccuauccugacaguggaagagaugaccaauuccagauuucccauuccgcuugagaagcuguucacagggccuagcggagccuucgucgugcagccccagaacggccgguguaccacggacgggguucuccugggaacaacccaacugucuccugugaauaucugcacauuucgcggcgaugucacccauaucgccggcacccacgacuacacaaugaaccucgcuucccagaauuggaacaauuaugaucccacggaagagauuccugcgccccuggggaccccggacuucgugggaaaaauccagggcguccuuacacagaccacaagaggggacggaagcacccggggccauaaggccacggugucuacaggguccguucacuuuaccccuaagcugggaagcgugcaauucaccacagauaccaacaaugacuuugaaacaggccagaacacgaaauucacccccgucggcgugguucaggauggaaauuccacacaccaaaacgagccccagcagugggugcucccuaauuacucugggcgcaccggccauaacguccaccuggcuccggccguggcccccacauuuccuggggaacagcuucuguucuuuagaagcaccaugcccggauguuccggcuacccuaauaugaaccucgacugccugcugccccaagagugggugcagcauuucuaucaggaggcugccccugcgcagagcgauguugcucuccugcgguuugucaaccccgacacggggcgcgugcuuuucgaauguaagcugcacaaaucuggcuacgugaccgucgcccacacaggacaacaugaucucgugauuccgccuaauggcuauuuuagauucgacuccuggguuaaccaguucuacacccuggcccccauggggaauggagcuggccggagacgcuga

SEQ ID NO: 29263 - RNA, 1617 nt, Artificial Sequence
  derived and/or modified sequence opt5 from VP1__Norovirus_and/or_Norovirus-like__EU839589
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcggagccuucgucgugcagccucagaauggccgguguacaaccgaugggguucuccugggaacgacacaacugucucccgugaacaucugcaccuuucgcggcgacgucacacauaucgcuggcuccagagauuacaccaugaaucucgcgagccugaacuggaauaacuaugacccuaccgaggaaauucccgccccucuugggacacccgacuucgugggaaaaauccagggcguccugacgcagaccacaaagggggauggaucuacccggggccacaaggcuacaguguacaccggguccgccccguuuacgccuaaacucggaagcguucaguuccgcacagacaccgagaaugauuuugaaacccaucaaaacacaaaguucacccccgugggcgucauucaggacggcuccacaacgcacagaaaugagccccagcaaugggugcugccuucuuacagcgggcggaacguucacaaugugcaucuugccccggcugucgcccccaccuuuccuggagaacagcuccuguucuuucgcuccacaaugcccggcuguagcggguauccuaacauggaucuggacugccugcucccccaggagugggugcagcacuucuaccaagaggcggcuccugcccagucugauguggcccugcuuagauuuguuaaucccgacaccggacggguccuguucgaauguaaacuccauaaguccggcuaugugacaguggcucacaccgggcagcacgaucuggucaucccgccuaacggcuacuuuagauucgacagcugggugaaccaguucuauacgcuugcccccaugggaaauggcaccgggcgccggagauga

SEQ ID NO: 29264 - RNA, 1617 nt, Artificial Sequence
  derived and/or modified sequence opt5 from VP1__Norovirus_and/or_Norovirus-like__KX353961
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccacauucgucgugcagccccagaacggacgguguaccacggauggcguucuccuggggacaacccaacugagcccugugaauaucugcacauuucgcggagacgucacccauaucgccggcucuagaaacuacaccaugaaucucgccucccagaacuggaauagcuaugaucccacagaggaaauuccugcuccccugggcacgccggacuucguggggaaaauccagggaguccuuacccagacaacccggacagacggcuccacccgcgggcacaaggcgacgguguacacaggaucugccgauuuuagcccuaagcugggcagaguucaauucgcuaccgacaccgauaacgacuuugaugccaaucagaacacaaaauucacccccgugggggucauucaggacggagauacagcccaucggaaugagccccaacagugggugcucccuuccuacagcggccgcaacacgcacaauguucaccuggcuccggccguggcgcccaccuuuccuggcgaacagcuucuguucuuuagaucuacaaugcccggguguuccggauauccuaacauggaccucgauugccugcugccccaggaguggguccaauacuucuaucaggaagcugccccugcccagagcgacguggcucuccugcgguuugugaaucccgauaccggcagaguucuuuucgaguguaagcugcauaaaucuggguacgucacaguggcccacaccggacagcaugaccucgugaucccgccuaacggcuauuuucgcuucgacagcugggucaaccaauucuacacgcuggcucccauggggaauggcaccggacggagacgcuga

SEQ ID NO: 29265 - RNA, 1617 nt, Artificial Sequence
  derived and/or modified sequence opt5 from VP1__Norovirus_and/or_Norovirus-like__AB933757
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucuccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccaccccgcuugagaagcuguucacagggccuuccagcaccuucgucgugcagccccagaacggacgguguacgacagauggcguucuccuggggaccacacaacugucuccugugaauauuugcaccuuucgcggagacgucacccauaucacaggcucccacaacuacacgaugaaucucgcuagccagaacuggaacuccuaugaucccaccgaggaaaucccugcuccccugggcacaccggacuucguggggaaaauucagggaguccuuacccagacaaccagaacggacggcucuacacgggggcauaaggccaccguguacaccggaagcgccgaguuuuccccuaagcugggccgcguucaaguggcgacagauaccaauaaugacuucgaugccaaccagaauacaaaauuuacgcccgucggggugauccaggacggaggcaccacacacagaaacgaaccccaacaguggguucucccuagcuacucuggccggaaugcucacaacgugcaucuggccccggccgucgcucccaccuucccuggggagcagcuucuguuuuuccgcuccacaaugcccggauguagcggcuauccuaauauggaucucgacugccugcugccccaggaaugggugcaacacuuuuaccaggaggccgcgccugcucagucugauguggcccuccugagauucguuaaccccgacaccgggcggguccuuuuugaguguaagcugcauaaaagcggauaugugacgguggcccacaccggccagcacgaucucgucauuccgccuaacggguacuucagauuugacuccugggugaaucaauucuauacacuggcucccaugggcaacggaaccggccgccggagauga

SEQ ID NO: 29266 - RNA, 1617 nt, Artificial Sequence
  derived and/or modified sequence opt5 from VP1__Norovirus_and/or_Norovirus-like__KM245074
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucgccacagacaccgagaacgauuuugaaacccaucaaaauacaaaguucaccccugugggagucauucaggacggcucuacaacgcaccgcaacgagccccagcaaugggugcugcccagcuacuccggcagaaauguucacaacgugcaucuugcuccugccgucgcgccgaauuuucccggggaacagcuccuguucuuucggagcaccaugccuggauguucuggcuaucccaacauggaucuggacugccugcucccucaggagugggugcagcacuucuaccaagaggcugcccccgcccaguccgauguggcucugcuucgcuuuguuaacccugacacagggagaguccuguucgaauguaaacuccauaagagcggauaugugaccguggcccacacaggccagcacgaucuggucauucccccgaauggguacuuucgguucgacucuugggugaaccaguucuauacccuugcuccuaugggcaauggaacgggcagacgccgguga

SEQ ID NO: 29267 - RNA, 1617 nt, Artificial Sequence
  derived and/or modified sequence opt5 from VP1__Norovirus_and/or_Norovirus-like__EU921368
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccugagccgcauguauaauggguacgccggaggcuucgaaguccaggugauccuugcuggcaacgccuuuaccgcugggaaaauuaucuucgccgcgguuccucccaauuuuccuacagagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacggucgaaucucgcaccaaacccuucuccguuccuauccugacaguggaggaaaugaccaauagcagauuucccauuccgcuugagaagcuguucacagggccuucuuccgcuuucgucgugcagccccagaacggacgguguaccacggauggcguucuccuggggacaacccaacugagcccugugaauaucugcacauuucgcggaaacgucaccaauaucgccggcucucagaccuacacaaugaaccucgccucccagaauuggaacaauuaugaccccacggaggaaauuccugcuccccugggcaccccggauuucguggggaaaauccagggaguccuuacacaaaccacaaagggcgacgggagcaccagaggacauaaggcgacgguguccacaggcucugcccaguuuaccccuaaacuggggagcguucaguucuccaccgacacaagcaccgauuuugagacaggacaaaacacgcgguucacccccgugggcgucauucaggacggcucuacaacccacaagaaugaaccccagcagugggugcucccuuccuacagcgggcgcgauucucauaacguucaccuggcuccggccguggcccccacauuuccuggagagcaaauccuuuucuuuagaagcaccaugcccggcuguuccggguacccuaauauggaccuggauugccuccugccccaggaauggguccagcacuucuaucaggagucugcuccugcccaaagcgacguggcgcugcuccgguuugugaaccccgauacgggacgcguucuguucgaguguaaacuucauaaguccggcuacgucaccguggcucacacagggcagcaugaccuggugauuccgccuaauggcuauuuuagauucgauagcugggucaaccaguucuacacccucgcccccaugggaaacggcgccgggcggagacgcuga

SEQ ID NO: 29268 - RNA, 1617 nt, Artificial Sequence
  derived and/or modified sequence opt5 from VP1__Norovirus_and/or_Norovirus-like__EU921338
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagaggcgacgggucuacccggggacacaaggccacgguguccacaggcagcguucauuuuaccccuaagcugggguccgugcaguucucuaccgauacaagcaaugacuuugagaccggacagaacacacgcuucacgcccgucggcgugguucaagauggcuccaccacacaccagaaugaaccccagcagugggugcucccugcuuacagcgggagagacaaccacaauguccaucuggccccggccguggcucccaccuuuccuggagagcaacuucuguucuuucggucuacaaugcccggcuguuccggguacccuaacaugaaucucgauugccugcugccccaggaaugggugcagcacuucuaucaggagagcgccccugcgcaaucugacguugcucuccugcgcuuugucaaccccgauaccggaagagugcuuuucgaguguaaacugcauaagagcggcuacgugacggucgcccacaccgggcagcacgaccucgugauuccgccuaacggcuauuuucgguucgauuccuggguuaaucaguucuacacacuggcccccaugggaaacggcgcugggagacgccgguga

SEQ ID NO: 29269 - RNA, 1617 nt, Artificial Sequence
  derived and/or modified sequence opt5 from VP1__Norovirus_and/or_Norovirus-like__LC005708
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguucagaaugugcaccuugccccggcugucgcccccaccuuuccuggagagcagcuccuguucuuucggucuacaaugcccggcuguuccggguauccuaacauggaucuggacugccugcucccccaggagugggugcaacauuucuaccaggaagcggcuccugcccagagcgauguggcccugcuucgcuuuguuaaucccgacaccggaagaguccuguucgaguguaaacuccacaagucuggcuaugugacaguggcucauaccgggcagcacgaucuggucaucccgccuaacggcuacuuucgguucgacagcugggugaaccaauucuauacgcuugcccccaugggaaauggcaccgggagacgccgguga

SEQ ID NO: 29270 - RNA, 1617 nt, Artificial Sequence
  derived and/or modified sequence opt5 from VP1__Norovirus_and/or_Norovirus-like__LC005704
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacgggguccgccccguuuacaccuaaacucggaagcguucaguucuccaccgacaccgaaaacgauuuugagacacaucagaauaccaaguucacacccgugggcgucauucaagacggcucuacgacccaccgcaacgaaccccagcagugggugcugccuagcuacuccgggagaaauguucacaacgugcaucuugccccggcugucgcccccacauuuccuggagagcaacuccuguucuuucggagcaccaugcccggcuguucuggguauccuaauauggaucuggacugccugcucccccaggagugggugcagcacuucuaccaggaagcggcuccugcccaauccgauguggcccugcuucgcuuuguuaaccccgacacaggaagaguccuguucgaguguaaacuccauaagagcggcuaugugaccguggcucacacggggcagcacgaucuggucaucccgccuaacggcuacuuucgguucgacucuugggugaaucaguucuauacccuugcccccaugggaaacggcacagggagacgccgguga

SEQ ID NO: 29271 - RNA, 1617 nt, Artificial Sequence
  derived and/or modified sequence opt5 from VP1__Norovirus_and/or_Norovirus-like__KF429777
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagauccaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucaguccaacgacagcacaauuaagcucaucgccaugcuguauacaccccuucgcgcuaauaacgccggcgaugacguuuucaccgugucuugcagagugcugacccggcccuccccugauuuugacuucauuuuucucgucccgcccacaguggaaagccgcaccaaaccuuucacgguucccauccugaccguggaggaaaugacaaacucuagauuuccuauuccccuugagaagcuguucaccgggccguccagcgccuucgucgugcagccucagaauggacgguguacaaccgauggcguucuccuggggacgacacaacugucucccgugaacaucugcaccuuucgcggagacgucacacauaucgcuggcuccagaaauuacaccaugaaccucgcgagccugaauugguccaacuaugauccuaccgaggaaauucccgccccucuuggcacacccgacuucguggggaaaauccagggaguccugacgcagaccacaaagggcgacgggucuacccggggacacaaggcuacaguguacaccggcagcgccgauuuuacgccgaaacucggguccguucaguucgccacagacaccgagaaugauuuugaaacccaucaaaacacacgcuucaccccugugggagucauucaggacggcggcacaacgcacagaaaugagccccagcaaugggugcugcccagcuacucugggcggaacguucacaaugugcaucuugcuccugccgucgcgccgaacuuucccggagaacagcuccuguucuuucgcuccaccaugccuggcuguagcggguaucccaauauggaucuggacugccugcucccucaggagugggugcagcacuucuaccaagaggcugcccccgcccagucugauguggcucugcuuagauuuguuaacccugacacaggacggguccuguucgaauguaagcuccauaaaagcggcuaugugaccguggcccacacagggcagcacgaucuggucauucccccgaauggcuacuuuagauucgacuccugggugaaccaguucuauacccuugcuccuaugggaaacggcacggggcgccggagauga

SEQ ID NO: 29272 - RNA, 1617 nt, Artificial Sequence
  derived and/or modified sequence opt5 from VP1__Norovirus_and/or_Norovirus-like__JX439840
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggauccccgauuucgugggaaaaauucagggcguccugacacagacgaccaagggggacggauccacacggggccacaaggcuaccguguacacagggagcgccccguuuaccccuaaacucggauccguucaguucucuacggacacagaaaaugauuuugagacccaucaaaacaccaaguucacacccgugggcgucauccaggacggcgggaccacacaccgcaaugaaccccagcaaugggugcugccuagcuacuccggaagaaacguucagaaugugcaccuugccccggcugucgcccccacguuuccuggcgagcagcuccuguucuuucggagcaccaugcccggguguucuggauauccuaacauggaucuggacugccugcucccccaggagugggugcaacauuucuaccaggaagcggcuccugcccaguccgauguggcccugcuucgcuuuguuaaucccgacacaggcagaguccuguucgaguguaaacuccacaagagcggguaugugaccguggcucauacaggccagcacgaucuggucauuccgccuaacggauacuuucgguucgacucuugggugaaccaauucuauacccuugcccccaugggcaaugggacgggaagacgccgguga

SEQ ID NO: 29273 - RNA, 1617 nt, Artificial Sequence
  derived and/or modified sequence opt5 from VP1__Norovirus_and/or_Norovirus-like__JX644026
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaaugcccagaacguucaccuugcuccggccguggcgcccaccuuuccuggggagcagcuccuguucuuucggucuacaaugcccggauguuccggcuauccuaauauggaucuggacugccugcucccccaggaguggguccaacauuucuaccaggaagcugccccugcccagagcgauguggcucugcuucgcuuugugaaccccgacaccgggagaguucuguucgaguguaaacuccacaagucuggauaugucacaguggcccauaccggccagcacgaucuggugaucccgccuaacggguacuuucgguucgacagcugggucaaucaauucuauacgcuugcucccaugggcaacggaaccggcagacgccgguga

SEQ ID NO: 29274 - RNA, 1617 nt, Artificial Sequence
  derived and/or modified sequence opt5 from VP1__Norovirus_and/or_Norovirus-like__JX459906
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucggaacagacaccgaaaacgauuuugagacccaucaaaauacaaaguucacccccgugggcgucauucaggacggcgggacaacgcaccgcaacgaaccccagcaaugggugcugccuucuuacagcggaagagauguuccgaaugugcaccuugcccccgcugucgccccuaccuuucccggcgagcagcuccuguucuuucgguccacaaugccuggguguagcggauaucccaacauggaccuggauugccugcucccucaggagugggugcagcauuucuaccaagaagcggcucccgcccagucugacguggcccugcuucgcuuuguuaauccggauaccggcagaguccuguucgaguguaaacuccacaaguccggguaugugacaguggcucauaccggccagcacgaccuggucaucccucccaacggauacuuucgguucgauagcugggugaaccaguucuauacgcuugccccuaugggcaaugggaccggaagacgccgguga

SEQ ID NO: 29275 - RNA, 1617 nt, Artificial Sequence
  derived and/or modified sequence opt5 from VP1__Norovirus_and/or_Norovirus-like__JX459597
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugccacgcgccucuuggcccggaucugaaccccuaccucucccaucuggcccgcauguauaauggguacgcuggaggcuucgaaguccaggugauccuugccggcaacgcuuuuaccgccgggaaaauuaucuucgcggccguuccucccaauuuuccuacagagggacugucucccagccaggugaccauguucccgcacaucauugucgacgugagacaacucgagccugugcugaucccccugccugauguccggaacaauuuuuaucauuacaaccaguccaaugaccccacaauuaagcucaucgcuaugcuguauacaccccuucgcgccaacaacgcuggcgaugacguuuucaccgugucuuguagagugcugacccggccuagcccggauuuugacuucauuuuucucgugcccccuacggucgaaucccgcaccaaacccuucagcguuccuauccugacaguggaggaaaugaccaauucuagauuucccauuccgcuugagaagcuguucacagggccuuccagcgccuucgucgugcagccccagaacggacggugcaccacggauggcguucuccuggggacaacccaacugucuccugugaauaucuguacauuucgcggagacgucacccacaucgccggcacccagaacuacacaaugaaucucgcuucccagaacuggaauaacuaugaucccacggaggaaauuccugcgccccugggcaccccggacuucguggggagaauccagggaguccuuacacaaaccacacggcgcgacggcagcaccagagggcauaaagccacgcugucuacaggauccgugcacuuuaccccuaagcucggcagcguucaguucuccaccgauacaucuaaugacuuugagaccgggcagaacacacgguucacgcccgugggagucgugcaagauggcagcaccacacaccagaaugaaccccagcaguggguucugccuaacuacuccggccgcgacagccauaaugugcaccuugcuccggccgucgcccccaccuuuccuggggagcaacuccuguucuuuagaucuacaaugcccggaugcuccggcuacccuaacaugaaucuggauugucugcucccccaggaaugggugcagcauuucuaucaggagagcgcuccugcccaaucugacguggcgcugcuucgguuuguuaaccccgauaccgggagaguccuguucgagugcaagcuccacaaaagcggauacgugacgguggcucacaccggccagcaugaccuggucauuccgccuaacggguauuuucgcuucgauuccugggugaaucaguucuacacacuugcccccaugggcaacggagccggccggagacgcuga

SEQ ID NO: 29276 - RNA, 1617 nt, Artificial Sequence
  derived and/or modified sequence opt5 from VP1__Norovirus_and/or_Norovirus-like__HQ456334
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcugacuuuacgccgaaacucgggagcguucaguucaauacagauaccgaaaacgacuuugagacccaucaaaauacaaaguucaccccugugggagucauucaggauggcuccacaacgcaccgcaacgaaccccagcaaugggugcugcccucuuacagcggcagaaauguucacaacgugcaucuugccccugcggucgcuccgaccuuucccggggagcagcuccuguucuuucgguccacaaugccuggauguagcggcuaucccaauauggaccuggauugccugcucccucaggagugggugcagcacuucuaccaagaagccgcccccgcucagucugacguggcccugcuucgcuuuguuaacccugauaccgggagaguccuguucgaguguaaacuccauaaguccggauaugugacaguggcucacaccggccagcacgaccuggucauucccccgaacggguacuuucgguucgauagcugggugaaucaguucuauacgcuugccccuaugggcaacggaaccggcagacgccgguga

SEQ ID NO: 29277 - RNA, 1617 nt, Artificial Sequence
  derived and/or modified sequence opt5 from VP1__Norovirus_and/or_Norovirus-like__HM802553
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugcuucuggcuggcaacgccuuuacagcggggaaaaucauuuucgccgcuguuccucccacguuuccuaccgagggacucucccccucucaggugacaauguucccgcauaucaucgucgacgugagacaacuggagccugugcugauuccccucccugauguccggaauaacuuuuaucacuacaaucagagcaacgacuccaccaucaagcugguugccaugcuuuauacaccccugcgcgcuaauaacgccggcgaugacguguucaccgugagcugcagaguccucacacggcccucuccugauuuugacuucauuuuucuggugccgcccaccguugaaucccgcacgaaaccuuucaccgugcccauccuuacagucgaggaaaugaccaacagcagauuuccuauuccccuggagcggcuguucacagggccgucuuccgccuucgugguucagccucagaauggacgcuguaccacggauggcgugcugcuggggacaacccaacucagccccgucaacaucugcacauuuagaggagacgugaccaauauuccuggcucucggaccuaccgcaugaaccuggcuucccagaauuggaacaauuaugaucccacagaggaaaucccugcgccccuuggcacgccggacuucgucgggaagauccagggagugcugacccagacaaccaaaggcgacgggagcacaagaggacauaaggccaccguucggacgggcuccgcugauuuuacaccuaagcucgggucugugcaauucgccaccgacaccgauaacgacuuugucacaggacagaauacccgcuucacacccgugggcguuauucacgauggcagcuccgcccauagaaacgagccccagcaaugggugcugccugaauacagcgggcggucuguccacaaugugcaccuugcuccggccguggcgcccacguuuccuggagagcagcuccucuucuuuagauccaccaugcccggcuguagcggguacccuaacauggaccuggauugccugcucccccaggaauggguucagcauuucuaucaagaggcugccccuucucagagcgacgucgcccugcuucgcuuugugaaucccgauacaggacgggugcuguucgaguguaaacuccacaaggcuggcuacgucaccguggcccauacagggcagcacgaccugguuaucccgccuaacggcuauuuuagauucgauuccugggugaaucaguucuacacccuugcucccaugggaaacggcgccgggcgccggagauga

SEQ ID NO: 29278 - RNA, 1617 nt, Artificial Sequence
  derived and/or modified sequence opt5 from VP1__Norovirus_and/or_Norovirus-like__HQ008055
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagcucaaugaccccaccauuaagcugaucgcuaugcuuuauacaccccugcgcgccaacaacgcuggcgaugacguuuucaccgugagcugcagagugcucacacggccuuccccggauuuugacuucauuuuucuggugcccccuaccgucgaaagccgcacgaaacccuucucuguuccuauccuuaccguggaggaaaugacaaauuccagauuucccauuccgcuggagaagcuguucaccgggccuagcucugccuucgucgugcagccccagaacggacgguguacaaccgauggcguucugcuggggacgacacaacucuccccugugaauaucugcaccuuucgcggagacgucacacauaucaccggcagccacaacuacaccaugaaucuggccucucagaacuggaacuccuaugaucccacagaggaaauuccugcuccccuuggcacgccggacuucguggggaaaauccagggaguccugacccagacaaccagagcggacggcagcacacgggggcaucgcgccaccguguacacgggauccgcugaguuugccccuaagcucggcagaguucaauucgccacagauaccgaaaaugacuuugauaccaaucagaacacaaaguucacccccgugggggucauucaggacggaaauacaacgcaccggaacgagccccaacagugggugcugccuucuuacagcggccgcaauucccacaacguucaucuugcuccggccguggcgcccaccuuuccuggcgaacagcuccucuucuuuagaagcacaaugcccggguguucuggauauccuaaucuggaucuggacugccuccugccccaggaguggguccaacacuucuaccaggaggcugccccugcccaguccgauguggcccuucugcgguuugugaaccccgacaccggcagaguucucuucgaauguaaacugcauaagagcggguaugucacaguggcucacaccggacagcacgaucuugugaucccgccuaacggcuacuuucgcuucgacucuugggucaaucaauucuauacgcuggcucccauggggaacggcaccggacggagacgcuga

SEQ ID NO: 29279 - RNA, 1617 nt, Artificial Sequence
  derived and/or modified sequence opt5 from VP1__Norovirus_and/or_Norovirus-like__AB541360
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagauucaucaaaauaccaaguucacacccgugggagucauccaggacggcagcaccacacaccgcaacgaaccccagcaaugggugcugccuuccuacagcggcagaaauguucacaacgugcaucuugccccggcugucgcccccacguuuccuggggagcagcuccuguucuuucggucuaccaugcccggauguuccggcuauccuaauauggaucuggacugccugcucccccaggagugggugcagcacuucuaccaagaagcggcuccugcccagagcgauguggcccugcuucgcuuuguuaaccccgacacagggagaguccuguucgaguguaaacuccauaagucuggauaugugaccguggcuuacacaggccagcacgaucuggucauuccgccuaacggguauuuucgguucgacagcugggugaaucaguucuacacccuugcccccaugggcaacggaacgggcagacgccgguga

SEQ ID NO: 29280 - RNA, 1617 nt, Artificial Sequence
  derived and/or modified sequence opt5 from VP1__Norovirus_and/or_Norovirus-like__AB541262
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauguggcuggcagcagaaauuacaucaugaaccucgcgucucugaauuggaacaauuaugacccuaccgaagagauucccgccccucuuggcacccccgauuucgucgggaaaauccagggagugcugacacagacgaccaagggcgacggguccacacggggacacaaggcuaccguuuacacaggcagcgccccguuuaccccuaaacucggguccgugcaguucucuacggacacagaaaacgauuuugagacccaucaaaauaccaaguucacacccgucggagugauucaggacggcagcaccacacaccgcaacgaaccccagcaauggguucugccuuccuacagcggcagaaaugugcacaacguccaucuugccccggcuguggcccccacguuuccuggggagcagcuccuguucuuucggucuaccaugcccggauguuccggcuauccuaauauggaucuggacugccugcucccccaggagugggugcagcacuucuaccaagaagcggcuccugcccagagcgauguugcccugcuucgcuuugucaaccccgacacagggagagugcuguucgaguguaaacuccauaagucuggauaugugaccgucgcucacacaggccagcacgaucuggugaucccgccuaacggguacuuucgguucgacagcuggguuaaucaguucuauacccuugcccccaugggcaacggaacgggcagacgccgguga

SEQ ID NO: 29281 - RNA, 1617 nt, Artificial Sequence
  derived and/or modified sequence opt5 from VP1__Norovirus_and/or_Norovirus-like__AB541231
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgcuguccagccucagaauggacgguguacaaccgacggcgugcuccuggggacgacacaacugucccccguuaacaucugcaccuuucgcggagaugugacacauaucgcgggcagcagaaauuacaccaugaaccucgccucucugaauuggaacaauuaugacccuaccgaagagauucccgcuccucuuggcacacccgauuucgucgggaaaauccagggagugcugacgcagaccacaaagggcgacggguccacccggggacacaaggccacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagaaaugugccgaacguucaccuugcucccgccguggcgccuaccuuucccggggagcagcuccuguucuuucggucuacaaugccuggauguuccggcuaucccaauauggaucuggacugccugcucccucaggaguggguccagcauuucuaccaagaagcugcccccgcccagagcgauguggcucugcuucgcuuugugaacccggacaccgggagaguucuguucgaguguaaacuccacaagucuggauaugucacaguggcccauaccggccagcacgaucuggugaucccucccaacggguacuuucgguucgacagcugggucaaucaguucuauacgcuugcuccuaugggcaacggaaccggcagacgccgguga

SEQ ID NO: 29282 - RNA, 1617 nt, Artificial Sequence
  derived and/or modified sequence opt5 from VP1__Norovirus_and/or_Norovirus-like__GQ246792
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuuaccccuaagcugggcagaguucaauucgccaccgacacagauaaugacuuugaugccaaucagaacaccaaauucacacccgugggggucauucaggacggaaauacggcucaucggaacgagccccaacagugggugcucccuucuuacagcggccgcaauucccacaacguucaccuggccccggcgguggcucccaccuuuccuggcgaacagcuucuguucuuuagaagcacaaugcccggguguucuggauauccuaauauggaucucgacugccugcugccccaggaguggguccaauacuucuaucaggaagccgccccugcucaguccgauguggcccuccugcgguuugugaaccccgacaccggcagaguucuuuucgaguguaagcugcauaaaagcggguacgucacaguggcucacaccggacagcaugaucucgugaucccgccuaacggcuauuuucgcuucgacucuugggucaaucaauucuacacgcuggcccccauggggaacggcaccggacggagacgcuga

SEQ ID NO: 29283 - RNA, 1617 nt, Artificial Sequence
  derived and/or modified sequence opt5 from VP1__Norovirus_and/or_Norovirus-like__AB504329
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacgggguccgccccguuuacaccuaaacucggaagcguucaguucuccaccgacaccgaaaacgauuuugagacacaucagaauaccaaguucacacccgugggcgucauucaagacggcgggacgacccaccgcaacgaaccccagcagugggugcugccuucuuacagcggaagaaauguucacaacgugcaucuugccccggcugucgcccccacauuuccuggcgagcaacuccuguucuuucgguccaccaugcccggguguagcggauauccuaauauggaucuggacugccugcucccccaggagugggugcagcacuucuaccaggaagcggcuccugcccaaucugauguggcccugcuucgcuuuguuaaccccgacacaggcagaguccuguucgaguguaaacuccauaaguccggguaugugaccguggcucacacgggccagcacgaucuggucaucccgccuaacggauacuuucgguucgacagcugggugaaucaguucuauacccuugcccccaugggcaacgggacaggaagacgccgguga

SEQ ID NO: 29284 - RNA, 1617 nt, Artificial Sequence
  derived and/or modified sequence opt5 from VP1__Norovirus_and/or_Norovirus-like__AB504306
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaagagcagauuuccuauuccccuugagaaacuguacaccgggccgucuuccgccuucgucgugcagccucagaacggacgguguacaaccgauggcguucuccuggggacgacacaacugagcguggucaauaucugcaccuuccgcggagacgugacacauaucgccggcucucacgauuauaccaugaaccucgcuucccagaauuggaacaauuacgaccccaccgaggaaauuccugcgccccugggcacaccugacuuugucgggaagauccagggaaugcuuacgcagaccacaagagaggauggcagcacccgggcccauaaggcuacaguguccaccgggucuguucacuucacgcccaaacugggaagcgugcaauacacaaccgacaccaacaaugauuuucagacaggccagaacaccaaguucacaccggucggggugauucaagacggaaauaaccaccagaaugaaccucagcaguggguucuccccaacuauuccggccgcacgggccauaaugugcaccuggcccccgccgucgcuccuaccuuuccgggggagcaacuucuguucuuuagaagcacaaugcccggauguucuggcuacccuaacaugaaccucgauugccugcugccccaggaaugggugcagcauuucuaucaggaggccgcgccugcucaauccgacguggcccuccugcgguuuguuaaucccgauaccgggcgcuuccuuuuugaguguaaacugcacaagagcggauacgucacaguggcccacaccggcccucaugaccucgugauucccccgaacggguauuucagauuugauucuugggucaaucaguucuacacgcuggcuccuaugggcaacggagccggccggagacgcguguga

SEQ ID NO: 29285 - RNA, 1617 nt, Artificial Sequence
  derived and/or modified sequence opt5 from VP1__Norovirus_and/or_Norovirus-like__GQ303445
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgaucaugacuuugaugcuaaucagaauacaaaauucacccccgugggggucauucaggacggagauacagcccaccggaacgagccccaacagugggugcucccuucuuacagcggccgcaauucccacaacguucaucuggcgccggcuguggcccccacguuuccuggcgaacagcuucuguucuuuagaagcaccaugcccggguguucuggauauccuaauauggaccucgauugccugcugccccaggaguggguccaauacuucuaucaggaagccgcuccugcccaguccgacguggcucuccugcgguuugugaaccccgauacaggcagaguucuuuucgaguguaagcugcacaaaagcggguacgucaccguggcccauacaggacagcacgaccucgugaucccgccuaauggcuauuuucgcuucgacucuugggucaaccaauucuacacccuggcgcccauggggaacggcacgggacggagacgcuga

SEQ ID NO: 29286 - RNA, 1617 nt, Artificial Sequence
  derived and/or modified sequence opt5 from VP1__Norovirus_and/or_Norovirus-like__EU839588
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccuggccguggaagagaugaccaacuccagauuuccuauuccccuugagaagcuguucacagggccgagcucugcucucgucgugcagccucagaauggacgguguaccacagacggcguucugcuggggaccacgcaacucucccccgugaacaucugcacauuccgcggagaugucacccauaucgcgggcagcagaaauuacacaaugaaccuggccucucuuaauuggaacaauuaugacccuaccgaagagauucccgcuccucugggcacccccgauuuuguggggaaaauccagggaguccucacacagacgaccaagggcgacggguccacacggggacacaaggccaccguguacacaggcagcgccccguucaccccuaaacugggguccguucaguuuggaacggacacagaaaacgauuucgagacccaucaaaauaccaaguuuacacccgugggcgucauucaggacggcucuaccacacaccgcaacgaaccccagcaaugggugcuuccuagcuacuccgggagaaauguucacaacgugcaucuggcuccggccgucgcgcccacguucccuggagagcagcuccuguuuuuccggagcaccaugcccggcuguucuggguauccuaauauggaucuggacugccuccugccccaggagugggugcagcacuuuuaccaagaagcugccccugcccaguccgauguggcccuucugcgcuucguuaaccccgacacaggaagaguccucuuugaguguaaacugcauaagagcggcuaugugaccguggcucacacagggcagcacgaucuugucaucccgccuaacggcuacuuccgguuugacucuugggugaaucaguucuauacccuggcucccaugggaaacggcacggggagacgccgguga

SEQ ID NO: 29287 - RNA, 1617 nt, Artificial Sequence
  derived and/or modified sequence opt5 from VP1__Norovirus_and/or_Norovirus-like__DQ364459
augaagauggccagcaacgacgcuuccucuagcgauggcuccaccgccaaucuggugcccgaggucaacaaugaaguuauggcgcucgagccuguggugggggcugccaucgccgcuccggucgccggacagcaaaacgugauugaccccuggaucagaaauaacuucguucaggcuccuggcggggaauuuacagugucuccccggaaugccccuggagagauucuguggagcgcgccccuuggcccugaucugaacccguaccucucccaccuggcccgcauguauaauggguacgcuggaggcuucgaaguccaggugauccuugccggcaacgcuuuuacggccgggaaaauuaucuucgcggccguucccccuaauuuucccaccgagggacugucuccuagccaggugacaauguucccccauaucauugucgacgugagacaacucgagccggugcugaucccucugcccgauguccggaacaauuuuuaucacuacaaccaguccaaugacccuaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucgccggcacccacgauuacacaaugaaccucgcuucucagaauuggaacaauuaugacccuacggaggaaauucccgcgccucugggcacccccgacuucguggggaaaauccagggaguccuuacacagaccacaagaggcgauggguccacccggggacauaaggccacggugagcacaggcuccguucacuuuaccccgaagcuggggucugugcaauucaccacagacaccaacaaugauuuugagacaggacagaacacgaaauucaccccugucggcgugguucaggacggcaauagcacacaccaaaacgaaccccagcagugggugcuccccaauuacuccgggcgcaccggacauaacguccaccuggcuccugccguggccccgacauuucccggcgagcagcuucuguucuuuagaagcaccaugccuggguguucuggauaccccaauaugaaccucgauugccugcugccucaagaaugggugcagcauuucuaucaggaggcugcccccgcgcaguccgacguugcucuccugcgguuugucaacccugauacgggccgcgugcuuuucgaguguaagcugcacaaaagcggguacgugaccgucgcccacacaggccaacaugaccucgugauucccccgaauggauauuuuagauucgauucuuggguuaaccaguucuacacccuggccccuaugggcaauggggcuggacggagacgcuga

SEQ ID NO: 29288 - RNA, 1617 nt, Artificial Sequence
  derived and/or modified sequence opt5 from VP1__Norovirus_and/or_Norovirus-like__KY628449
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuagcccggaucugaaccccuaccucucccaccuggcucgcauguauaauggcuacgccgggggauucgaaguccaggugauccuugcuggcaacgccuuuacagcgggcaaaguuauuuucgccgcugugccucccaauuuuccuacggaggggcugucucccagccaggucaccauguucccgcauaucgugguggacgucagacaacucgagccuguucugaucccccugccugaugugcggaacaauuuuuaucacuacaaccaguccaaugacagcacaauuaagcucaucgccaugcuguauacaccccuucgcgcuaacaacgccggagaugacguguucaccgucucuugcagagugcugacccggcccuccccugauuuugacuucauuuuucucguuccgcccacaguggaaagccgcaccaaaccuuucucuguccccgugcugacgguugaggaaaugaccaauuccagauuuccuaucccccuugagaagcuguucacaggcccgagcucugauuucgccgugcagccucagaacgggcgguguaccacagacggaguccuccugggcaccacgcaacugucccccgugaauauuugcacauuucgcggggaugucacccauaucaacggaagcuccaauuacaaaaugaaccucgcuaaucagaacuggucuaauuaugacccuacagaggaaauucccgcgccucugggcgcccccgacuucgugggcaagauccaggggguucuuacccagaccacaaaggaggauggaagcacgagaggccacaaagcuaccguguacacaggguccgccgacuuugccccgaagcugggacggguccaauucgaaaccgauacagaccaugaucucgagaucgaccagaacaccaaauuuacgccugugggcguuauucagaaugggggaacaacccaccgcaacgaacccaagcaauggaugcugcccagcuacucuggcagaaauaccccuaacgugcaccuugcuccggccgucgcgcccacauucccuggcgagcagcugcucuuuuuccgguccaccaugcccggguguagcggauauccuaauauggaucuggacugccugcucccccaggagugggugcagcauuuuuaccaagaagcugccccugcccagucugauguggcucugcuucgcuucguuaaccccgacacaggcagaguccuguuugaguguaaacuccacaagagcggguaugugacgguggcccauuccggacagcacgaucuggucgugccgccuaacggcuacuuccgguuugacucuuggguuaaucaguucuauacccuugcucccauggggaacggcagcggaagacgccgguga

SEQ ID NO: 29289 - RNA, 1617 nt, Artificial Sequence
  derived and/or modified sequence opt5 from VP1__Norovirus_and/or_Norovirus-like__KX371608
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucacgguucccauccugaccguggaggaaaugacaaauagcagauuuccuauuccccuugagaagcuguucaccgggccgucuuccgccuucgucgugcagccucagaacggacgguguacaaccgauggcguucuccuggggacgacacaacugagccccgugaauaucugcaccuuucgcggagacgucacacauaucgcuggcucucacaacuacaccaugaaucucgcgucccugaacuggaauaacuaugauccuaccgaggaaauucccgccccucuuggcacacccgacuucguggggaaaauccagggaguccugacgcagauuaccaagggcgacgggagcacaagaggacauaaggcuaccguguacacaggcuccgccgauuuuaccccgaaacucgggucuguucaguucgccacggacacagagaaugauuuucaaacccaccagaacacccgguucacaccugugggagucauccaggacggcggcaccacacaccaaaaugaaccccagcagugggugcugcccagcuacuccgggcgcaacguucauaaugugcaccuugcuccugccgucgcgccgaacuuucccggagagcagcuccuguucuuuagaagcacgaugccuggcuguucuggguaucccaauauggaucuggacugccugcucccucaagaaugggugcagcauuucuaccaggaggcugcccccgcccaguccgauguggcucugcuucgguuuguuaacccugacaccggacgcguccuguucgaguguaagcuccacaaaagcggcuaugugacaguggcccacaccgggcaacaugaucuggucauucccccgaacggcuacuuuagauucgacucuugggugaaucaguucuauacacuugcuccuaugggaaacggcaccgggcggagacgcuga

SEQ ID NO: 29290 - RNA, 1617 nt, Artificial Sequence
  derived and/or modified sequence opt5 from VP1__Norovirus_and/or_Norovirus-like__KX354089
augaagauggccagcaacgacgcuaaucccuccgauggcucugccgcgagccuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucacgguucccauccugaccguggaggaaaugacaaauagcagauuuccuauuccccuugagaagcuguucaccgggccgucuuccgccuucgucgugcagccucagaacggacgguguacaaccgauggcguucuccuggggacgacacaacugagccccgugaauaucugcaccuuucgcggagacgucacacauaucgcuggcucuagaaacuacaccaugaaucucgcgucccugaacuggaauaacuaugauccuaccgaggaaauucccgccccucuuggcacacccgacuucguggggaaaauccagggaguccugacgcagaccacaaagggcgacgggagcacccggggacacaaggcuacaguguacaccggcuccgccgauuuuacgccgaaacucgggucuguucaguucgccacagacaccgagaaugauuuugaaacccaucaaaacacaaaguucaccccugugggagucauucaggacggcggcacaacgcaccgcaaugagccccagcaaugggugcugcccagcuacuccgggagaaacguucacaaugugcaucuugcuccugccgucgcgccgaacuuucccggagaacagcuccuguucuuucggagcaccaugccuggcuguucuggguaucccaauauggaucuggacugccugcucccucaggagugggugcagcacuucuaccaagaggcugcccccgcccaguccgauguggcucugcuucgcuuuguuaacccugacacaggaagaguccuguucgaauguaaacuccauaagagcggcuaugugaccguggcccacacagggcagcacgaucuggucauucccccgaacggcuacuuucgguucgacucuugggugaaucaguucuauacccuugcuccuaugggaaacggcacggggagacgccgguga

SEQ ID NO: 29291 - RNA, 1617 nt, Artificial Sequence
  derived and/or modified sequence opt5 from VP1__Norovirus_and/or_Norovirus-like__KX354001
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucacgguucccauccugaccguggaggaaaugacaaauagcagauuuccuauuccccuugagaagcuguucaccgggccgucuuccgccuucaucguccagccucagaacggacgguguacaaccgauggcgugcuccuggggacgacacaacugagccccguuaauaucugcaccuuucgcggagacgugacacauauugcuggcucuagaaacuacaccaugaaucucgcgucccugaacuggaauaacuaugauccuaccgaggaaauccccgccccucuuggcacacccgacuucgucgggaaaauucagggagugcugacgcagaccacaaagggcgacgggagcacccggggacacaaggcuacagucuacaccggcuccgccgauuuuacgccgaaacucgggucugugcaguucgccacagacaccgagaaugauuuugaaacccaucaaaacacacgcuucaccccuguuggagugauccaggacggcggcacaacgcacagaaaugagccccagcaauggguccugcccagcuacuccgggcggaacgugcacaauguucaucuugcuccugccguggcgccgaacuuucccggagaacagcuccuguucuuucgcagcaccaugccuggcuguucuggguaucccaauauggaucuggacugccugcucccucaggaguggguccagcacuucuaccaagaggcugcccccgcccaguccgauguggcucugcuuagauuugugaacccugacacaggacggguucuguucgaauguaagcuccauaaaagcggcuaugucaccguggcccacacagggcagcacgaucuggugauucccccgaacggcuacuuuagauucgacucuugggucaaucaguucuauacccuugcuccuaugggaaacggcacggggcgccggagauga

SEQ ID NO: 29292 - RNA, 1617 nt, Artificial Sequence
  derived and/or modified sequence opt5 from VP1__Norovirus_and/or_Norovirus-like__KX353971
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucaccggcucuagaaacuacaccaugaaucucgccucccagaacuggaauagcuaugaucccacagaggaaaucccugcuccccugggcacgccggacuucgucgggaaaauucagggagugcuuacccagacaacccggacagacggcuccacccgcgggcacaaggcgacgguuuacacaggaucugccgauuuuagcccuaagcugggcagagugcaauucgcuaccgacaccgauaacgacuuugagacaaaucagaacaccaaauucacacccgucggggugauccaggauggaggcacgacccaucggaaugaaccccaacaguggguucucccuuccuacagcggccgcaacacacacaaugugcaccuggccccggccgucgcucccaccuuuccuggggagcagcuucuguucuuuagaucuacaaugcccggauguuccggcuauccuaacauggaccucgauugccugcugccccaggaaugggugcaauacuucuaucaggaggccgcgccugcucagagcgacguggcccuccugcgguuuguuaaucccgauaccgggagaguccuuuucgaguguaagcugcauaaaucuggauacgugacgguggcccacaccggccagcaugaccucgucauuccgccuaacggguauuuucgcuucgauagcugggugaaccaauucuacacacuggcucccaugggcaauggaaccggccggagacgcuga

SEQ ID NO: 29293 - RNA, 1617 nt, Artificial Sequence
  derived and/or modified sequence opt5 from VP1__Norovirus_and/or_Norovirus-like__KR131766
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaaugaccaacuccagauuuccuauuccccuugagcggcuguacacagggccgagcucugccuucgucgugcagccucagaauggacgcuguaccacggauggcguucuccuggggacaacccaacuguccgccgugaacaucugcacauucagaggagacgucacccauaucgcuggcagccggaauuauaccaugaaccucgcgucucagaauuggaacaauuacgaucccacagaggaaauuccugcuccccugggcacgccugacuuuguggggaagauccagggaaugcuuacccagacaacccgcuccgacggcagcacaagagggcacaaagccaccguccugacgggauccgccgauuucgcccccaagcucggccgggugcaauuugcuacagacaccgauaacgacuucgagucugggcagaauaccaaguuuacaccgguuggagugauucaggauggcagcaccacacaucgcaacgaaccucaacaguggguccugcccaauuacuccggcagaacggggcacaacgugcaccuugcccccgcgguugcuccuaccuauccgggagagcagcuccuguucuuucggagcacaaugcccggcuguucuggguacccuaauauggaccuggauugccugcucccccaggaaugggugcaacauuucuaucaggaggccgccccugcucaguccgacgucgcccugcuuagauuugugaaccccgauaccggacgcgugcuguucgaguguaaacuccacaagagcggcuacguuacagucgcucauaccgggcagcacgaccuggugaucccucccaacggcuauuuucgguucgauucuugggugaaucaauuuuacacgcuugccccgaugggaaacggcaccgggagacgccgguga

SEQ ID NO: 29294 - RNA, 1617 nt, Artificial Sequence
  derived and/or modified sequence opt5 from VP1__Norovirus_and/or_Norovirus-like__AB663685
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcgccaaaccuuucaccguucccauccugacgguggaggaaaugaccaacuccagauuuccuauuccccuugagaagcuguucacagggccgagcucugcuuucgucgugcagccucagaauggacgguguaccacagauggcguucuccuggggaccacgcaacugucccccgugaacaucugcacauuucgcggagacgucacccauaucgcgggcagcagaaauuacacaaugaaccucgccucucugaauuggaacaauuaugauccuaccgaggaaauucccgcuccucuuggcacccccgacuucguggggaaaauccagggaguccugacacagacgaccaagggcgacggguccacacggggacacaaggccaccguguacacaggcagcgccgauuuuaccccgaaacucggguccguucaguucggaacggacacagagaacgauuuugaaacccaucaaaauaccaaguucacaccugugggcgucauucaggacggcgggaccacacaccgcaacgagccccagcaaugggugcugcccucuuacagcggaagaaauguucacaacgugcaucuugcuccugccgucgcgccgaauuuucccggcgaacagcuccuguucuuucgguccacgaugccuggguguagcggauaucccaacauggaucuggacugccugcucccucaggagugggugcagcacuucuaccaagaggcugcccccgcccagucugauguggcucugcuucgcuuuguuaacccugacaccggcagaguccuguucgaauguaaacuccauaaguccggguaugugacaguggcccacaccggccagcacgaucuggucauucccccgaauggauacuuucgguucgacagcugggugaaccaguucuauacacuugcuccuaugggcaaugggaccggaagacgccgguga

SEQ ID NO: 29295 - RNA, 1617 nt, Artificial Sequence
  derived and/or modified sequence opt5 from VP1__Norovirus_and/or_Norovirus-like__AB933746
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuguuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuauucugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucgccggcucucacaacuacaccaugaaucucgcuucccagaacuggaauagcuaugaucccaccgaggaaaucccugcgccccugggcacaccggacuucgucgggaaaauucagggagugcuuacgcagaccacaagaaccgacggcuccacacgggggcauaaggccaccguuuacacgggaucugcugaguuuagcccuaagcugggccgcgugcaauucgccacagauaccaacaaugacuuugaugccaaccagaauaccaaauucacacccgucggggugauccaggacggaggcaccacacacagaaacgaaccccaacaguggguucucccuuccuacagcggccggaauacgcacaacgugcaucuggcuccggccgucgcgcccaccuuuccuggggagcagcuucuguucuuucgcucuacaaugcccggauguuccggcuauccuaauauggaucucgacugccugcugccccaggaaugggugcaauacuucuaucaggaggcugccccugcccagagcgauguggcucuccugagauuuguuaaccccgacaccgggcggguccuuuucgaguguaagcugcacaaaucuggauacgugacaguggcccauaccggccagcacgaucucgucauuccgccuaacggguauuuuagauucgacagcugggugaaucaauucuacacgcuggcucccaugggcaacggaaccggccgccggagauga

SEQ ID NO: 29296 - RNA, 1617 nt, Artificial Sequence
  derived and/or modified sequence opt5 from VP1__Norovirus_and/or_Norovirus-like__AB933701
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaagauguuuucaccguguccugcagagugcugacacggcccagcccugacuuugauuucaucuuucucgucccgcccaccguggagucucgcacaaaaccuuucaccguucccauucugacgguggaagagaugaccaacuccagauuuccuaucccccuugagaagcuguucacagggccgagcucugccuucgucgugcagccucagaauggacgguguaccacagacggcguucuccuggggaccacgcaacugucccccgugaacaucugcacauuucgcggagaugucacccauauugcuggcagcagaaauuacacaaugucucucgcgucccugaacuggaauaacuaugacccuaccgaagagauccccgccccucuuggcacccccgauuucguggggaaaauucagggaguccugacacagacgaccaagggcgacgggagcacacggggacacaaggcuaccguguacacaggcuccgccccguuuaccccuaaacucgggucuguucaguucagcacggacacagaaaaugauuuugagacccaucaaaacaccaaguucacacccgugggagucauccaggacggcggcaccacacaccgcaaugaaccccagcaaugggugcugccuuccuacagcgggagaaacguuccgaaugugcaccuugcccccgcugucgccccuacguuucccggagagcagcuccuguucuuucggucuaccaugccuggcuguuccggguaucccaacauggaucuggacugccugcucccucaggagugggugcagcauuucuaccaagaagcggcucccgcccagagcgauguggcccugcuucgcuuuguuaauccggacacaggaagaguccuguucgaguguaaacuccacaagucuggcuaugugaccguggcucauacagggcagcacgaucuggucauuccucccaacggcuacuuucgguucgacagcugggugaaccaguucuauacccuugccccuaugggaaauggcacggggagacgccgguga

SEQ ID NO: 29297 - RNA, 1617 nt, Artificial Sequence
  derived and/or modified sequence opt5 from VP1__Norovirus_and/or_Norovirus-like__AB933686
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaagauguuuucaccguguccugcagagugcugacacggcccagcccugacuuugauuucaucuuucucgucccgcccaccguggagucucgcacaaaaccuuucaccguucccauucugacgguggaagagaugaccaacuccagauuuccuaucccccuugagaagcuguucacagggccgagcucugccuucgucgugcagccucagaauggacgguguaccacagacggcguucuccuggggaccacgcaacugucccccgugaacaucugcacauuucgcggagaugucacccauauugcuggcagcagaaauuacacaaugaaccucgcgucucugaauuggaacaauuaugacccuaccgaagagauccccgccccucuuggcacccccgauuucguggggaaaauucagggaguccugacacagacgaccaagggcgacggguccacacggggacacaaggcuaccguguacacaggcagcgccccguuuaccccuaaacucggguccguucaguucucuacggacacagaaaacgauuuugagacccaucaaaauaccaaguucacacccgugggagucauccaggacggcggcaccacacaccgcaacgaaccccagcaaugggugcugccuagcuacuccgggagaaauguuccgaacgugcaccuugcccccgcugucgccccuacguuucccggagagcagcuccuguucuuucggagcaccaugccuggcuguucuggguaucccaauauggaucuggacugccugcucccucaggagugggugcagcauuucuaccaagaagcggcucccgcccaguccgauguggcccugcuucgcuuuguuaacccggacacaggaagaguccuguucgaguguaaacuccacaagagcggcuaugugaccguggcucauacagggcagcacgaucuggucauuccucccaacggcuacuuucgguucgacucuugggugaaucaguucuauacccuugccccuaugggaaacggcacggggagacgccgguga

SEQ ID NO: 29298 - RNA, 1617 nt, Artificial Sequence
  derived and/or modified sequence opt5 from VP1__Norovirus_and/or_Norovirus-like__AB933680
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacagcccaccgcaacgaaccccagcaaugggugcugccuuccuacagcggcagaaauguucagaacgugcaccuugcuccggccgucgcgcccacguuuccuggggagcagcuccuguucuuucggucuaccaugcccggauguuccggcuauccuaauauggaucuggacugccugcucccccaggagugggugcaacauuucuaccaggaagcugccccugcccagagcgauguggcucugcuucgcuuuguuaaccccgacacagggagaguccuguucgaguguaaacuccacaagucuggauaugugaccguggcccauacaggccagcacgaucuggucaucccgccuaacggguacuuucgguucgacagcugggugaaucaauucuauacccuugcucccaugggcaacggaacgggcagacgccgguga

SEQ ID NO: 29299 - RNA, 1617 nt, Artificial Sequence
  derived and/or modified sequence opt5 from VP1__Norovirus_and/or_Norovirus-like__AB933672
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagccacaauuacaccaugaaccucgcgucucugaauuggaacaauuaugacccuaccgaagagauucccgccccucuuggcacacccgauuucguggggaaaauccagggaguccugacgcagaccacaaagggcgacggguccaccagaggacauaaggcuacaguguacaccggcagcgccccguuuacgccuaaacucggguccguucaguucucuacagacaccgaaaacgauuuugagacccaccaaaauacaaaguucacccccgugggagucauucaggacggcggcacagcccaccggaacgaaccccagcaaugggugcugccuagcuacuccgggcgcaauguucagaacgugcaucuugcuccggccgucgcgcccacguuuccuggagagcagcuccuguucuuuagaagcaccaugcccggcuguucuggguauccuaauauggaucuggacugccugcucccccaggagugggugcaacacuucuaccaggaagcugccccugcccaguccgauguggcucugcuucgguuuguuaaccccgacacaggacgcguccuguucgaguguaaacuccauaagagcggcuaugugaccguggcccacacagggcagcacgaucuggucaucccgccuaacggcuacuuuagauucgacucuugggugaaucaauucuauacccuugcucccaugggaaacggcacggggcggagacgcuga

SEQ ID NO: 29300 - RNA, 1617 nt, Artificial Sequence
  derived and/or modified sequence opt5 from VP1__Norovirus_and/or_Norovirus-like__AB933664
augaagauggccagcaacgacgcuacccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcucugccuucgucgugcagccucagaacggacgguguaccacggacggcguucuccuggggacaacccaacugucccccgugaauaucugcacauuucgcggagaugucacccauaucgcuggcagcagaaacuacaccaugaaucucgcgucucugaacuggaauaacuaugacccuacagaagagauucccgccccucuuggcacgcccgauuucguggggaaaauccagggaguccugacccagacaaccaagggcgacggguccacacggggacacaaggcuaccguguacacgggcagcgccccguuuacaccuaaacucggguccguucaguucaauaccgacaccgaaaacgauuuugagacacaucaaaauaccaaguucacacccgugggagucauucaggacggcucuacgacccaccgcaacgaaccccagcaaugggugcugccuagcuacuccggcagaaauguuccgaacgugcaccuugcccccgcugucgccccuacauuucccggggagcagcuccuguucuuucggagcaccaugccuggauguucuggcuaucccaauauggaucuggacugccugcucccucaggagugggugcagcauuucuaccaagaagcggcucccgcccaguccgauguggcccugcuucgcuuuguuaacccggacacagggagaguccuguucgaguguaaacuccacaagagcggauaugugaccguggcucauacgggccagcacgaucuggucaucccucccaacggguacuuucgguucgacucuugggugaaucaguucuauacccuugccccuaugggcaacggaacaggcagacgccgguga

SEQ ID NO: 29301 - RNA, 1617 nt, Artificial Sequence
  derived and/or modified sequence opt5 from VP1__Norovirus_and/or_Norovirus-like__AB933662
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaucuuucccggagagcagcuccuguucuuucggagcaccaugccuggcuguucuggguaucccaauauggaucuggacugccugcucccucaggagugggugcagcauuucuaccaagaagcggcucccgcccaguccgauguggcccugcuucgcuuuguuaacccggacacaggaagaguccuguucgaguguaaacuccacaagagcggcuaugugaccguggcucauacagggcagcacgaucuggucauuccucccaacggcuacuuucgguucgacucuugggugaaucaguucuauacccuugccccuaugggaaacggcacggggagacgccgguga

SEQ ID NO: 29302 - RNA, 1617 nt, Artificial Sequence
  derived and/or modified sequence opt5 from VP1__Norovirus_and/or_Norovirus-like__AB933656
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguucacaaugugcaucuugccccggcugucgcccccaccuuuccuggagagcagcuccuguucuuucggucuacaaugcccggcuguuccggguauccuaacauggaucuggacugccugcucccccaggagugggugcagcacuucuaccaagaagcggcuccugcccagagcgauguggcccugcuucgcuuuguuaaucccgacaccggaagaguccuguucgaguguaaacuccauaagucuggcuaugugacaguggcucacaccgggcagcacgaucuggucaucccgccuaacggcuacuuucgguucgacagcugggugaaccaguucuauacgcuugcccccaugggaaauggcaccgggagacgccgguga

SEQ ID NO: 29303 - RNA, 1617 nt, Artificial Sequence
  derived and/or modified sequence opt5 from VP1__Norovirus_and/or_Norovirus-like__EU921340
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcacccaggaguacaccaugaaccucgcuucucagaauuggaacaauuaugaucccacagaagagauuccugcgccccugggcacgccggacuucguggggaaaauccagggaguccuuacccaaacaaccagacgggacggcuccacacgcgggcacaaggccaccgugagcacgggauccguucauuuuacaccuaagcugggccggauucaguucucuaccgauaccagcaacgacuuugaaacagggcagaauaccagauucacacccgugggagucgugcaagauggcuccacgacccaccagaacgagccccagcaguggguucucccugacuacagcggccgcgauucucacaaugugcaucuggcuccggccgucgcccccuccuuuccuggggaacaacuucuguucuuuagaagcacaaugcccggauguucuggcuacccuaacaugaaucucgacugccugcugccccaggagugggugcagcacuucuaucaggaggcugccccugcgcaaagcgauguggcucuccugcgguuuguuaaccccgacaccgggagaguccuuuucgaauguaaacugcauaaguccggauacgugacaguggcccacaccggccagcacgaucucgucaucccgccuaauggguauuuucgcuucgacucuugggugaaccaguucuacacgcuggcccccaugggcaacggaaccggccggagacgcuga

SEQ ID NO: 29304 - RNA, 1617 nt, Artificial Sequence
  derived and/or modified sequence opt5 from VP1__Norovirus_and/or_Norovirus-like__KC962453
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaauuuccccucggaaugcccccggagagauccuguggucugcgccucuuggcccggaucugaaccccuaccucagccaccuggcccgcauguauaauggguacgcuggaggcuucgaagugcaggucauucuugccggcaacgcuuuuacggccgggaaagugaucuucgcggccguuccucccaauuuuccuaccgagggacugucccccucucaggugacaauguucccgcauaucgucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccauuccugugcugaccaucgaggaaaugacaaauagcagauuucccauuccgcuugagaagcuguucaccgggccuucuuccgccuucgucgugcagccccagaacggacgguguagcacagauggcguucuccuggggaccacgcaacugucuccugugaauaucugcacauuucgcggagacgucacccauaucgccggcucccacaacuacacaaugaaucucgcuagccagaacuggaacuccuaugaucccaccgaggaaauuccugcgccccugggcaccccggacuucguggggaaaauccagggaguccuuacacagacgaccagagccgacggcucuacacgggggcauaaggcuaccgugcugacaggaagcgccaauuuuaccccuaagcucggccgcauucaauucgccacggauacagacaaugauuuugagaccaaccagaauaccaaauucacacccguuggggugauccaggacggagauaccgcucacagaaacgaaccccaacaguggguccugccuuccuacagcggccggaauacacacaacgugcaucuugccccggcgguugcucccacguuuccuggcgagcagcuccuguucuuucgcucuaccauucccggguguuccggauacccuaauauggaccuggauugccugcucccccaggaaugggugcaauucuuuuaucaggaggccgccccugcucagagcgacgucgcccugcuuagauucgugaaccccgauacaggccgggugcuguuugaguguaagcuccacaaaucuggguacaucaccguugcucauacaggacagcacgaccuggucaucccgccuaacggcuauuucagauucgauagcugggugaaucaauuuuacacccuugcccccauggggaacggcacgggacgccggagauga

SEQ ID NO: 29305 - RNA, 1617 nt, Artificial Sequence
  derived and/or modified sequence opt5 from VP1__Norovirus_and/or_Norovirus-like__KF712501
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccauccugacgguggaggaaaugaccaacagcagauuuccuauuccccuugagaagcuguucacagggccgucuuccaccuucgucgugcagccucagaauggacgguguacaaccgauggcguucuccuggggacgacacaacugagccccgugaacaucugcaccuuucgcggagacgucacacauaucaccggcucuagaaauuacaccaugaaccucgccucccagaauuggaacagcuaugauccuacagaggaaauucccgcuccucugggcacgcccgacuucguggggaaaauccagggaguccuuacccagacaacccggacagacggcuccacccgcgggcacaaggcgacgguguacacaggaucugccgauuuuagcccgaagcugggcagaguucaauucgcuaccgacaccgauaaugacuuugauacaaaccagaauaccaaauucacaccugugggggucauucaggacggaggcacgacccaucggaacgagccccaacagugggugcuccccuccuacagcggccgcaauacacacaacguucaccuggccccugccguggcuccgaccuuucccggggaacagcuucuguucuuuagaucuacaaugccuggauccagcggcuaucccaauauggaucucgacugucugcugccucaggaguggguccaauacuucuaucaggaagccgcgcccgcucagucugauguggcccuccugcgguuugugaacccugacaccgggagaguucuuuucgagugcaagcugcauaaaagcggauacgucacgguggcccacaccggccagcaugaucucgugauucccccgaacggguauuuucgcuucgacuccugggucaaucaauucuacacacuggcuccuaugggcaacggaaccggccggagacgcuga

SEQ ID NO: 29306 - RNA, 1617 nt, Artificial Sequence
  derived and/or modified sequence opt5 from VP1__Norovirus_and/or_Norovirus-like__JX459903
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgaucaugacuuugaugcuaaucagaauacaaaauucacccccgugggggucauucaggacggagauacagcccaccggaacgagccccaacagugggugcucccuucuuacagcggccgcaauucccacaacguucaucuggcgccgacgguggcucccaccuuuccuggcgaacagcuucuguucuuuagaagcacaaugcccggguguucuggauauccuaauauggaccucgauugccugcugccccaggaguggguccaauacuucuaucaggaagccgccccugcucaguccgacguggcccuccugcgguuugugaaccccgauaccggcagaguucuuuucgaguguaagcugcacaaaagcggguacgucacaguggcucauaccggacagcacgaccucgugaucccgccuaauggcuauuuucgcuucgacucuugggucaaccaauucuacacgcuggcccccauggggaacggcaccggacggagacgcuga

SEQ ID NO: 29307 - RNA, 1617 nt, Artificial Sequence
  derived and/or modified sequence opt5 from VP1__Norovirus_and/or_Norovirus-like__JX459629
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacauggaucuggacugccugcucccucaggagugggugcagcauuucuaccaagaagcggcucccgcccagagcgauguggcccugcuucgcuuuguuaauccggacaccggaagaguccuguucgaguguaaacuccacaagucuggcuaugugacaguggcucauaccgggcagcacgaucuggucaucccucccaacggcuacuuucgguucgacagcugggugaaccaguucuauacgcuugccccuaugggaaauggcaccgggagacgccgguga

SEQ ID NO: 29308 - RNA, 1617 nt, Artificial Sequence
  derived and/or modified sequence opt5 from VP1__Norovirus_and/or_Norovirus-like__JX445165
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucuccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccgggccuuccagcacauucgucgugcagccccagaacggacgguguaccacggauggcguucuccuggggacaacccaacugucuccugugaauaucugcacauuucgcggagacgucacccauaucaccggcuccagaaacuacacaaugaaucucgcuagccagaacuggaacuccuaugaucccacggaggaaauuccugcuccccugggcaccccggacuucguggggaaaauccagggaguccuuacacagaccacacggaccgacggcucuacgcgcgggcacaaggccacaguguacaccggaagcgccgaguuuuccccuaagcugggcagaguucaauucgcgaccgauacagacaaugauuuugacgccaaucagaacaccaaauucacacccgugggggucauucaggauggaggcacgacccaucggaaugaaccccaacagugggugcucccuagcuacucuggccgcaacacacacaauguucaccuggcuccggccguggcccccaccuuuccuggggagcagcuucuguucuuuagauccacaaugcccggauguagcggcuauccuaacauggaccucgauugccugcugccccaggaauggguccaacauuucuaccaggaggcugccccugcgcagucugacguggcucuccugcgguuugugaaucccgauaccgggagaguucuuuucgaguguaagcugcacaaaagcggauaugucacgguggcccauaccggccagcacgaccucgugaucccgccuaacggguacuuucgcuucgauuccugggucaaccaauucuauacacuggcccccaugggcaauggaaccggccggagacgcuga

SEQ ID NO: 29309 - RNA, 1617 nt, Artificial Sequence
  derived and/or modified sequence opt5 from VP1__Norovirus_and/or_Norovirus-like__HM635156
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaucgauggcguucuccuggggaccacgcaacugagcccugugaauaucugcacauuucgcggagacgucacccauauuacaggcucuagaaacuacaccaugaaucucgccacccagaacuggaacuccuaugaucccacagaggaaaucccugcuccccugggcacgccggacuucguggggaaaauucagggaguccuuacccagacaacccgggcggacggcagcacacgcgggcacaaggccaccguguacacgggauccgcugauuuugccccuaagcugggcagaguucaauucgccacagacaccgauaaugacuuugaugcuaaucagaacaccaaauucacacccgugggggucauccaggacggaaauaccgcccaucggaacgagccccaacagugggugcucccuucuuacagcggccgcaauucccacaacguucaccuggcgccggcuguggcccccacauuuccuggcgaacagcuucuguucuuuagaagcacgaugcccggguguucuggauauccuaauauggaucucgacugccugcugccccaggaguggguccaauacuucuaucaggaagccgcuccugcccaguccgauguggcucuccugcgguuugugaaccccgacaccggcagaguucuuuucgaguguaagcugcauaaaagcggguacgucacaguggcccacaccggacagcaugaucucgugauuccgccuaacggcuauuuucgcuucgacucuugggucaaucaauucuacacacuggcgcccauggggaacggcaccggacggagacgcuga

SEQ ID NO: 29310 - RNA, 1617 nt, Artificial Sequence
  derived and/or modified sequence opt5 from VP1__Norovirus_and/or_Norovirus-like__JQ622197
augaagauggccagcaacgacgcuaaucccuccgauggcucugccgcgagccuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcuccacaacgcaccgcaaugaaccccagcaaugggugcugccuagcuacucuggcgggaacguucacaaugugcaucuugccccggcugucgcccccaccuuuccuggagagcagcuccuguucuuuagauccacaaugcccggcuguagcggguauccuaacauggaucuggacugccugcucccccaggagugggugcagcacuucuaccaagaagcggcuccugcccagucugauguggcccugcuucgguuuguuaaucccgacaccggacgcguccuguucgaguguaaacuccauaagagcggcuaugugacaguggcucacaccgggcagcacgaucuggucaucccgccuaacggcuacuuuagauucgacuccugggugaaccaguucuauacgcuugcccccaugggaaauggcaccgggcggagacgcuga

SEQ ID NO: 29311 - RNA, 1617 nt, Artificial Sequence
  derived and/or modified sequence opt5 from VP1__Norovirus_and/or_Norovirus-like__JQ613520
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagagcggcuaugugacaguggcucauaccgggcagcacgaucuggucaucccuucuaacggcuacuuucgguucgacagcugggugaaucaguucuauacgcuugcccccaugggaaacggcaccgggagacgccgguga

SEQ ID NO: 29312 - RNA, 1617 nt, Artificial Sequence
  derived and/or modified sequence opt5 from VP1__Norovirus_and/or_Norovirus-like__HQ456320
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaagauucacgcccgucggagugguucaagauggcuccaccacacaccagaaugaaccccagcagugggugcucccuaacuacagcggccgggacucucacaauguccaucuggcuccggccguggcccccaccuuuccuggggagcaacuucuguucuuucgcuccacaaugcccggauguagcggcuacccuaacaugaaucucgauugccugcugccccaggaaugggugcagcacuucuaucaggagucugcuccugcccaaagcgacguugcgcuccugagauuugucaaccccgauaccgggcgggugcuuuucgaguguaaacugcauaaguccggauacgugacggucgcucacaccggccagcacgaccucgugauuccgccuaacggguauuuuagauucgauucuuggguuaaucaguucuacacacuggcccccaugggcaacggagccggccgccggagauga

SEQ ID NO: 29313 - RNA, 1617 nt, Artificial Sequence
  derived and/or modified sequence opt5 from VP1__Norovirus_and/or_Norovirus-like__AB541353
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacauggaucuggacugccugcucccucaggagugggugcagcauuucuaccaagaagcggcucccgcccagagcgauguggcccugcuucgcuuuguuaauccggacaccggaagaguccuguucgaguguaaacuccacaagucuggcuaugugacaguggcucauaccgggcagcacgaucuggucaucccucccaacggcuacuuucgguucgacagcugggugaaccaguucuauacgcuugccccuaugggaaauggcaccgggagacgccgguga

SEQ ID NO: 29314 - RNA, 1617 nt, Artificial Sequence
  derived and/or modified sequence opt5 from VP1__Norovirus_and/or_Norovirus-like__AB541348
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucgccacagacaccgagaacgauuuugaaacccaucaaaauacaaaguucaccccugugggagucauucaggacggcggcacaacgcaccgcaacgagccccagcaaugggugcugcccucuuacagcgggagaaauguucacaacgugcaucuugcuccugccgucgcgccgaauuuucccggagaacagcuccuguucuuucgguccaccaugccuggcuguagcggguaucccaacauggaucuggacugccugcucccucaggagugggugcagcacuucuaccaagaggcugcccccgcccagucugauguggcucugcuucgcuuuguuaacccugacacaggaagaguccuguucgaauguaaacuccauaaguccggcuaugugaccguggcccacacagggcagcacgaucuggucauucccccgaauggcuacuuucgguucgacagcugggugaaccaguucuauacccuugcuccuaugggaaauggcacggggagacgccgguga

SEQ ID NO: 29315 - RNA, 1617 nt, Artificial Sequence
  derived and/or modified sequence opt5 from VP1__Norovirus_and/or_Norovirus-like__AB541339
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcaacacaacgcaccgcaaugaaccccagcaaugggugcugccuagcuacuccggcagaaacguucagaaugugcaccuugccccggcugucgcccccaccuuuccuggggagcagcuccuguucuuucggagcacaaugcccggauguucuggcuauccuaacauggaucuggacugccugcucccccaggagugggugcaacauuucuaccaggaagcggcuccugcccaguccgauguggcccugcuucgcuuuguuaaccccgacaccgggagaguccuguucgaguguaaacuccacaagagcggauaugugacaguggcucauaccggccagcacgaucuggucaucccgccuaauggguacuuucgguucgacucuugggugaaccaauucuauacgcuugcccccaugggcaauggaaccggcagacgccgguga

SEQ ID NO: 29316 - RNA, 1617 nt, Artificial Sequence
  derived and/or modified sequence opt5 from VP1__Norovirus_and/or_Norovirus-like__AB541303
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcuguuuuuacgccgaaacucgggagcgugcaguucuccacagacaccgaaaaugauuuugagacccaucaaaacacaaaguucaccccugucggagugauucaggacggcucuacaacgcaccgcaaugaaccccagcaauggguucugcccagcuacuccggcagaaacgugcacaauguccaucuugccccugcgguggcuccgaccuuucccggggagcagcuccuguucuuucggagcacaaugccuggauguucuggcuaucccaacauggaucuggacugccugcucccucaggagugggugcagcacuucuaccaagaagccgcccccgcucaguccgauguugcccugcuucgcuuugucaauccugacaccgggagagugcuguucgaguguaaacuccauaagagcggauaugugacagucgcucacaccggccagcacgaucuggugauucccccgaacggguacuuucgguucgacucuuggguuaaccaguucuauacgcuugccccuaugggcaauggaaccggcagacgccgguga

SEQ ID NO: 29317 - RNA, 1617 nt, Artificial Sequence
  derived and/or modified sequence opt5 from VP1__Norovirus_and/or_Norovirus-like__GQ246799
augaagauggccagcaacgacgcuaaucccuccgauggcucugccgcgaaccuggugccugagaucaauaacgaagucauggcucucgagccgguugugggggccgccauugcugcccccguggcuggacagcaaaaugucaucgacccuuggauuagaaacaauuucgugcaggcccccggcggggaauuuaccguuagcccucggaacgcgcccggagagauccugugguccgccccucuuggcccggaucugaaucccuaccucucucaccuggcucgcauguauaacggguacgccggaggcuucgaagugcaggucauuccugcuggcaaugccuuuacagcggggaaaaucaucuucgccgcugugcccccuaacuuucccacggagggacuuagcccgucccagguuaccauguucccucauauuaucguggacgucagacaacuggagcccgugcucauuccucugcccgaugugcggaauaacuuuuaucacuacaaucagucuaacgacagcacaaucaagcugauugccaugcucuauacaccccugcgcgcuaacaaugccggcgaugacgucuucaccguuuccugcagagugcuuacccggccuagcccggauuuugacuucaucuuucuggugcccccuacagucgaaucucgcaccaaacccuucacggugccuauucucaccguugaggaaaugacaaacuccagauuucccaucccgcuggagaaacuuuucaccgggccuagcucugccuucgugguccagccccagaauggacgguguacaaccgauggcgugcugcucgggacgacacaacuguccccuguuaacaucugcaccuuucgcggagacgugacacauauugcuggcagcagaaauuacaccaugaaccuggcgucucucaauuggaacaauuaugaucccaccgaggaaaucccugcuccccugggcacaccggacuucgucgggaagauucagggagugcuuacgcagaccacaaaggaggacggcuccacccgggggcacaaggccacagucuacaccggaagcgccgauuuuacgccuaaacugggcuccgugcaguucgggacagacaccgaaaacgauuuugagacccaucaaaauacaaaguucacccccguuggagugauccaggacggcucuacaacgcaccgcaacgaaccccagcaauggguccucccuagcuacuccggcagaaaugugcacaacguucaucuggccccggcuguggcccccaauuuuccuggggagcagcuucuguucuuucggagcaccaugcccggauguucuggcuauccuaacauggaucucgacugccugcugccccaggaguggguccagcacuucuaccaagaagcggcuccugcccaguccgauguggcccuccugcgcuuugugaaccccgacacagggagaguucuuuucgaguguaaacugcauaagagcggauaugucaccguggcucacacaggccagcacgaucucgugauuccgccuaauggguacuuucgguucgacucuugggucaaccaguucuauacccuggcccccaugggcaauggaacgggcagacgccgguga

SEQ ID NO: 29318 - RNA, 1617 nt, Artificial Sequence
  derived and/or modified sequence opt5 from VP1__Norovirus_and/or_Norovirus-like__EU876886
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcucugugaauaucugcaccuuuagaggagacgucacacauaucgccggcacccaggaguacaccaugaaccucgcuucccagaauuggaacaauuaugauccuacagaagagauucccgcgccucugggcacgcccgacuucguggggaagauccagggaguccuuacccaaacaacccggcgcgacggcagcacaagagggcacaaagccaccguguccacgggaucuguucauuuuacaccgaagcugggccggauucaguucagcaccgauaccuccaacgacuuugaaacagggcagaauacccgcuucacaccugugggagucgugcaagauggcagcacgacccaccagaacgagccccagcaguggguucuccccaauuacucuggcagagacgggcacaacgugcaucuggcuccugccgucgccccguccuuucccggagaacaacuucuguucuuucggagcacaaugccuggcuguucuggguaccccaauaugaaccucgauugccugcugccucaggagugggugcagcacuucuaucaggaggcugcccccgcgcaaagcgacguggcucuccugagauuuguuaauccugauaccggacgcguccuuuucgaauguaagcugcauaaauccggcuacgugacaguggcccacaccgggcagcacgaccucgucauucccccgaacggcuauuuucgguucgauucuugggugaaccaguucuacacgcuggccccuaugggaaauggcaccgggagacgccgguga

SEQ ID NO: 29319 - RNA, 1617 nt, Artificial Sequence
  derived and/or modified sequence opt5 from VP1__Norovirus_and/or_Norovirus-like__AB385630
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaaggaagacgggucuacccggggacacaaggcuacaguguacaccggcuccgccccguuuacgccuaaacucgggagcguucaguucuccacagacaccgagaacgauuuugaaacccaucaaaauacaaaguucacccccgugggagucauucaggacggcucuacaacgcaccgcaacgagccccagcaaugggugcugccuagcuacuccggcagaaauguucacaacgugcaucuugccccggcugucgcccccaccuuuccuggggagcagcuccuguucuuucggagcacaaugcccggauguucuggcuauccuaauauggaucuggacugccugcucccccaggaaugggugcagcacuucuaccaagaggcggcuccugcccaguccgauguggcccugcuucgcuuuguuaaccccgacaccgggagaguccuguucgaauguaaacuccauaagagcggauaugugacaguggcucacaccggccagcacgaucuggucaucccgccuaacggguacuuucgguucgacucuugggugaaucaguucuauacgcuugcccccaugggcaacggaaccggcagacgccgguga

SEQ ID NO: 29320 - RNA, 1617 nt, Artificial Sequence
  derived and/or modified sequence opt5 from VP1__Norovirus_and/or_Norovirus-like__KU182483
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaagauucacgcccgucggagugguucaagauggcuccaccacacaccagaaugaaccccagcagugggugcucccugacuacagcggccgggauucucacaacguccaucuggcuccggccguggcccccaccuuuccuggggagcaacuucuguucuuucgcuccacaaugcccggauguagcggcuacccuaauaugaaccucgacugccugcugccccaggaaugggugcagcacuucuaucaggagucugcuccugcccaaagcgauguugcgcuccugagauuugucaaucccgacaccgggcgggugcuuuucgaguguaaacugcauaaguccggauacgugacggucgcucacaccggccagcacgaucucgugauuccgccuaacggguauuuuagauucgacucuuggguuaaccaguucuacacacuggcccccaugggcaauggagccggccgccggagauga

SEQ ID NO: 29321 - RNA, 1617 nt, Artificial Sequence
  derived and/or modified sequence opt5 from VP1__Norovirus_and/or_Norovirus-like__AB665364
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaauguucagaacgugcaccuugccccggcugucgcccccaccuuuccuggggagcagcuccuguucuuucggucuacaaugcccggauguuccggcuauccuaauauggaucuggacugccugcucccccaggagugggugcaacauuucuaccaggaagcggcuccugcccagagcgauguggcccugcuucgcuuuguuaaccccgacaccgggagaguccuguucgaguguaaacuccacaagucuggauaugugacaguggcucauaccggccagcacgaucuggucaucccgccuaacggguacuuucgguucgacagcugggugaaucaauucuauacgcuugcccccaugggcaacggaaccggcagacgccgguga

SEQ ID NO: 29322 - RNA, 1617 nt, Artificial Sequence
  derived and/or modified sequence opt5 from VP1__Norovirus_and/or_Norovirus-like__AB663686
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaugacguuuucaccguguccugcagagugcugacacggcccagcccugauuuugacuucaucuuucucgucccgcccaccguggaaucucgcacaaaaccuuucaccguucccauucugacgguggaggaaaugaccaacuccagauuuccuaucccccuugagaagcuguucacagggccgagcucugccuucgucgugcagccucagaauggacgguguaccacagauggcguucuccuggggaccacgcaacugucccccgugaacaucugcacauuucgcggagacgucacccauauugcuggcagcagaaauuacacaaugaaccucgcgucucuguccuggaauaacuaugauccuaccgaggaaauccccgccccucuuggcacccccgacuucguggggaaaauucagggaguccugacacagacgaccaagggcgacgggagcacacggggacacaaggcuaccguguacacaggcuccgccccguuuaccccuaaacucgggucuguucaguucagcacggauacagagaaugacuuugaaacccaucaaaacaccaaguucacacccgugggagucauccaggauggcggcaccacacaccgcaaugagccccagcaaugggugcugccuuccuacagcgggagaaacguuccgaaugugcaccuugcccccgcugucgccccuacguuucccggagaacagcuccuguucuuucggucuaccaugccuggcuguuccggguaucccaacauggaccuggauugccugcucccucaggagugggugcagcauuucuaccaagaggcggcucccgcccagagcgacguggcccugcuucgcuuuguuaauccggauacaggaagaguccuguucgaauguaaacuccacaagucuggcuaugugaccguggcucauacagggcagcacgaccuggucauuccucccaacggcuacuuucgguucgauagcugggugaaccaguucuauacccuugccccuaugggaaauggcacggggagacgccgguga

SEQ ID NO: 29323 - RNA, 1617 nt, Artificial Sequence
  derived and/or modified sequence opt5 from VP1__Norovirus_and/or_Norovirus-like__AB933702
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaauguuccgaacgugcaccuugcccccgcugucgccccuaccuuucccggggagcagcuccuguucuuucggucuacaaugccuggauguuccggcuaucccaauauggaucuggacugccugcucccucaggagugggugcagcauuucuaccaagaagcggcucccgcccagagcgauguggcccugcuucgcuuuguuaacccggacaccgggagaguccuguucgaguguaaacuccacaagucuggauaugugacaguggcucauaccggccagcacgaucuggucaucccucccaacggguacuuucgguucgacagcugggugaaucaguucuauacgcuugccccuaugggcaacggaaccggcagacgccgguga

SEQ ID NO: 29324 - RNA, 1617 nt, Artificial Sequence
  derived and/or modified sequence opt5 from VP1__Norovirus_and/or_Norovirus-like__AB933685
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagagacuacaccaugaaucucgcgucucugaacuggaauaacuaugauccuaccgaagagauucccgccccucuuggcacacccgacuucguggggaaaauccagggaaugcugacgcagaccacaaagggcgacggguccacccggggacacaaggcuacagucuacaccggcagcgccccguuuacgccuaaacucggguccgugcgcuucucuacagauaccgaaaaugacuuugagauucaucagaacaccaaguucacacccguuggagugauccaagauggcagcaccacacacagaaaugaaccccagcaguggguccugccuuccuacagcggccgggacgcccacaacgugcaucuugcuccggccguugcgcccacguuuccuggggagcaacuccuguucuuucgcucuaccaugcccggauguuccggcuauccuaauauggaucuggacugccugcucccccaggagugggugcagcacuucuaccaggaagcugccccugcccaaagcgaugucgcucugcuuagauuugugaaccccgacacagggcgggugcuguucgaguguaaacuccauaagucuggauauguuaccgucgcccacacaggccagcacgaucuggugauuccgccuaauggguacuuuagauucgacagcugggugaaccaguucuauacccuugcucccaugggcaacggaacgggccgccggagauga

SEQ ID NO: 29325 - RNA, 1617 nt, Artificial Sequence
  derived and/or modified sequence opt5 from VP1__Norovirus_and/or_Norovirus-like__AB933645
augaagauggccagcaacgacgcuacccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcucugccuucgucgugcagccucagaacggacgguguaccacggacggcguucuccuggggacaacccaacugucccccgugaauaucugcacauuucgcggagaugucacccauaucgcuggcagcagaaacuacaccaugaaucucgcgucucugaacuggaauaacuaugacccuacagaagagauucccgccccucuuggcacgcccgauuucguggggaaaauccagggaguccugacccagacaaccaagggcgacggguccacacggggacacaaggcuaccguguacacgggcagcgccccguuuacaccuaaacucggguccguucaguucucuaccgacaccgaaaaugauuuugagacacaucaaaacaccaaguucacacccgugggagucauucaggacggcggcacgacccaccgcaaugaaccccagcaaugggugcugccuagcuacuccgggagaaacguuccgaaugugcaccuugcccccgcugucgccccuacauuucccggagagcagcuccuguucuuucggagcaccaugccuggcuguucuggguaucccaacauggaucuggacugccugcucccucaggagugggugcagcauuucuaccaagaagcggcucccgcccaguccgauguggcccugcuucgcuuuguuaauccggacacaggaagaguccuguucgaguguaaacuccacaagagcggcuaugugaccguggcucauacggggcagcacgaucuggucaucccucccaacggcuacuuucgguucgacucuugggugaaccaguucuauacccuugccccuaugggaaauggcacagggagacgccgguga

SEQ ID NO: 29326 - RNA, 1617 nt, Artificial Sequence
  derived and/or modified sequence opt5 from VP1__Norovirus_and/or_Norovirus-like__LC005706
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaaugcccacaacguucaucuugcuccggccguggcgcccaccuuuccuggggagcagcuccuguucuuucggucuacaaugcccggauguuccggcuauccuaauauggaucuggacugccugcucccccaggaguggguccagcacuucuaccaagaagcugccccugcccagagcgauguggcucugcuucgcuuugugaaccccgacaccgggagaguucuguucgaguguaaacuccauaagucuggauaugucacaguggcccacaccggccagcacgaucuggugaucccgccuaacggguacuuucgguucgacagcugggucaaucaguucuauacgcuugcucccaugggcaacggaaccggcagacgccgguga

SEQ ID NO: 29327 - RNA, 1617 nt, Artificial Sequence
  derived and/or modified sequence opt5 from VP1__Norovirus_and/or_Norovirus-like__KM198562
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucaucguccagccucagaauggccgguguacaaccgacggggugcuccugggaacgacacaacugucucccguuaacaucugcaccuuucgcggcgaugugacacauauugcuggcuccagagacuacaccaugaaucucgcgagccugaacuggaauaacuaugauccuaccgaagagauccccgccccucuugggacacccgacuucgucggaaaaauucagggcgugcugacgcagaccacaaagggggacggaucuacccggggccacaaggcuacagucuacaccggguccgccccguuuacgccuaaacucggaagcgugcaguucuccacagauaccgaaaaugacuuugaggcccaucaaaacaccaaguucacacccguuggcgugauccaggauggcgggaccacacaccgcaaugaaccccagcaauggguccugccuucuuacagcggaagagacgugcacaacguucaucuugcuccggccguggcgcccacguuuccuggcgagcagcuccuguucuuucgguccaccaugcccggguguagcggauauccuaauauggaucuggacugccugcucccccaggaguggguccagcacuucuaccaagaagcugccccugcccagucugauguggcucugcuucgcuuugugaaccccgacacaggcagaguucuguucgaguguaaacuccauaaguccggguaugucaccguggcccacacaggccagcacgaucuggugauuccgccuaauggauacuuucgguucgacagcugggucaaccaguucuauacccuugcucccaugggcaacgggacgggaagacgccgguga

SEQ ID NO: 29328 - RNA, 1617 nt, Artificial Sequence
  derived and/or modified sequence opt5 from VP1__Norovirus_and/or_Norovirus-like__KC409311
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugguucuugccggcaacgcuuuuacggccgggaaaaucauuuucgcggccgugccucccaauuuuccuaccgagggacugucccccucucaggucacaauguucccgcauaugaucguggacgugagacaacucgagccuguccugaucccccugccugauguucggaacaauuuuuaucacuacaaccagagcaaugaccccaccauuaagcucaucgcuaugcuguauacaccccuucgcgccaacaacgcuggcgaugacguguucaccguguccugcagaguccugacacggccuagcccggauuuugacuucauuuuucucgugcccccuaccguugaaucucgcacgaaacccuucuccgugccuauccugaccgucgaggaaaugacaaauagcagauuucccauuccgcuugagaagcuguucaccgggccuucuuccgccuucgugguucagccccagaacggacgguguacaaccgauggcgugcuccuggggacgacacaacugagcccugucaauaucugcaccuuucgcggagacgugacacauauuaccggcucucacaacuacaccaugaaucucgccacacagaacuggaacuccuaugaucccacggaggaaaucccugcuccccugggcaccccggacuucgucgggaaaauccagggagugcuuacacagaccacaagagcggacggcagcacccgggggcauaaggccacgguuuacacaggauccgcugauuuugccccuaagcugggccgcgugcaauucgccaccgacaccaauaaugaucucggggcuaaccagaauacaaaauuuacccccgucggagugauucaggacggcggcacagcccacagaaacgagccccaacaguggguucugccuucuuacagcgggcgcaauucccacaacgugcaucuugcgccggcugucgcccccacguucccuggagaacagcugcucuuuuuccggagcaccaugcccggcuguucuggguauccuaauauggaucuggacugccugcucccccaggagugggugcaauacuuuuaucaggaagccgcuccugcccaguccgauguggcucugcuuagauucguuaaccccgacacaggacggguccuguuugaguguaagcuccacaaaagcggcuacgugaccguggcccauacagggcagcacgaucuggucaucccgccuaacggcuauuucagauuugacucuugggugaaucaauucuacacccuugcgcccaugggaaacggcacggggcgccggagauga

SEQ ID NO: 29329 - RNA, 1617 nt, Artificial Sequence
  derived and/or modified sequence opt5 from VP1__Norovirus_and/or_Norovirus-like__KC409263
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagagacuacaccaugaaucucgcgagccugaacuggaauaacuaugauccuaccgaagagauucccgccccucuugggacacccgacuucgugggaaaaauccagggcguccugacgcagaccacaaagggggacggaucuacccggggccacaaggcuacaguguacaccggguccgccccguuuacgccuaaacucggaagcguucaguucuccacagauaccgaaaaugacuuugaggcccaucaaaacaccaaguucacacccgugggcgucauucaggauggcgggaccacacaccgcaaugaaccccagcaaugggugcugccuucuuacagcggaagagacguucacaacgugcaucuugcuccggccgucgcgcccacguuuccuggcgagcagcuccuguucuuucgguccaccaugcccggguguagcggauauccuaauauggaucuggacugccugcucccccaggagugggugcagcacuucuaccaagaagcugccccugcccagucugauguggcucugcuucgcuuuguuaaccccgacacaggcagaguccuguucgaguguaaacuccauaaguccggguaugugaccguggcccacacaggccagcacgaucuggucaucccgccuaauggauacuuucgguucgacagcugggugaaccaguucuauacccuugcucccaugggcaacgggacgggaagacgccgguga

SEQ ID NO: 29330 - RNA, 1617 nt, Artificial Sequence
  derived and/or modified sequence opt5 from VP1__Norovirus_and/or_Norovirus-like__JX459900
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccauccugacgguggaggaaaugaccaacagcagauuuccuauuccccuugagaagcuguucacagggccgucuuccaccuucgucgugcagccucagaauggacgguguacaaccgauggcguucuccuggggacgacacaacugagccccgugaacaucugcaccuuucgcggagacgucacacauaucgccggcucuagaaauuacaccaugaaccucgcuucccagaauuggaacagcuaugauccuaccgaggaaauucccgcgccucugggcacacccgacuucguggggaaaauccagggaguccuuacgcagaccacacggaccgacggcuccacacgcgggcacaaggccaccguguacacgggaucugcugauuuuagcccgaagcugggcagaguucaauucgccacagacaccgauaaugacuuugaugccaaccagaauaccaaauucacaccugugggggucauucaggacggaaacaccgcucaucggaaugagccccaacagugggugcuccccuccuacagcggccgcaacacacacaauguucaccuggccccugcgguggcuccgacguuucccggcgaacagcuucuguucuuuagaucuaccaugccuggguguuccggauaucccaacauggaucucgacugccugcugccucaggaguggguccaauacuucuaucaggaagccgcccccgcucagagcgauguggcccuccugcgguuugugaacccugacacaggcagaguucuuuucgaguguaagcugcauaaaucuggguacgucaccguggcucacacaggacagcaugaucucgugauucccccgaauggcuauuuucgcuucgacagcugggucaaccaauucuacacccuggccccuauggggaauggcacgggacggagacgcuga

SEQ ID NO: 29331 - RNA, 1617 nt, Artificial Sequence
  derived and/or modified sequence opt5 from VP1__Norovirus_and/or_Norovirus-like__JX459617
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaauguucacaacgugcaucuugccccggcugucgcccccaccuuuccuggggagcagcuccuguucuuucggucuacaaugcccggauguuccggcuauccuaauauggaucuggacugccugcucccccaggagugggugcagcacuucuaccaagaagcggcuccugcccagagcgauguggcccugcuucgcuuuguuaaccccgacaccgggagaguccuguucgaguguaaacuccauaagucuggauaugugacaguggcucacaccggccagcacgaucuggucaucccgccuaacggguacuuucgguucgacagcugggugaaucaguucuauacgcuugcccccaugggcaacggaaccggcagacgccgguga

SEQ ID NO: 29332 - RNA, 1617 nt, Artificial Sequence
  derived and/or modified sequence opt5 from VP1__Norovirus_and/or_Norovirus-like__GQ845366
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuaauuacagcgggagaaacguuccgaaugugcaccuugcccccgcugucgccccuaccuuucccggagagcagcuccuguucuuucgguccacaaugccuggcuguagcggguaucccaacauggaucuggacugccugcucccucaggagugggugcagcauuucuaccaagaagcggcucccgcccagucugauguggcccugcuucgcuuuguuaacccggacaccggaagaguccuguucgaguguaaacuccacaaguccggcuaugugacaguggcucauaccgggcagcacgaucuggucaucccuagcaauggcuacuuucgguucgacucuugggugaaccaguucuauacgcuugcccccaugggaaauggcaccgggagacgccgguga

SEQ ID NO: 29333 - RNA, 1617 nt, Artificial Sequence
  derived and/or modified sequence opt5 from VP1__Norovirus_and/or_Norovirus-like__GQ845345
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggauaugaaccccuaccugagccaccucgcccgcauguauaauggguacgcuggaggcuucgaaguccaggugauccuggccggcaacgcuuuuacggccgggaaaauuaucuucgcggccguuccucccaauuuuccuaccgagggacuuucccccucucaggugacaauguucccgcauaucauugucgacgugagacaacuggagccugugcucaucccccugccugauguccggaacaauuuuuaucacuacaaccagagcaaugaccccaccauuaagcugaucgcuaugcucuauacaccccugcgcgccaacaacgcuggcgaugacguuuucaccguguccugcagagugcuuacacggccuagcccggauuuugacuucauuuuucuggugcccccuaccgucgaaucucgcacgaaacccuucuccguuccuauccucaccguggaggaaaugacaaauagcagauuucccauuccgcuggagaaacuuuucaccgggccuucuuccgccuucgucgugcagccccagaacggacgguguacaaccgauggcguucugcucgggacgacacaacugagcccugugaauaucugcaccuuucgcggagacgucacacauaucgccggcucuagaaacuacaccaugaaucuggcuucccagaacuggaauagcuaugaucccaccgaggaaauuccugcgccccucggcacaccggacuucguggggaagauccagggaguccugacgcagaccacacggaccgacggcuccacacgcgggcacaaggccaccguguacacgggaucugcugauuuuagcccuaaacuuggcagaguucaauucgccacagacaccgauaacgacuuuguggccaaucagaacaccaaguucacacccgucggggugauucaggauggaaauaccgcucaucggaacgagccccaacaguggguucugccuuccuacagcggccgcaauacacacaacgugcaccucgccccggcggucgcucccacguuuccuggcgaacagcugcuuuucuuuagaucuaccaugcccggguguuccggauauccuaauauggaccuggauugccuccugccccaggagugggugcaauacuucuaucaggaagccgccccugcucagagcgacguggcccugcuccgguuuguuaaccccgauacaggcagaguccuguucgaguguaaacuucauaagucuggguacgugaccguggcucacacaggacagcaugaccuggucaucccgccuaacggcuauuuucgcuucgauagcugggugaaucaauucuacacccucgcccccauggggaacggcacgggacggagacgcuga

SEQ ID NO: 29334 - RNA, 1617 nt, Artificial Sequence
  derived and/or modified sequence opt5 from VP1__Norovirus_and/or_Norovirus-like__GQ845341
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcggagccuucgucgugcagccucagaauggccgguguacaaccgaugggguucuccugggaacgacacaacugucucccgugaacaucugcaccuuucgcggcgacgucacacauaucgcuggcuccagagauuacaccaugaaucucgcgagccugaacuggaauaacuaugacccuaccgaggaaauucccgccccucuugggacacccgacuucgugggaaaaauccagggcguccugacgcagaccacagagggggauggaucuacccggggccacaaggcuacaguguacaccggguccgccccguuuacgccuaagcucggaagcguucaguucuccacagacaccgaaaaugauuuugagacccaucaaaacacaaaauucacccccgugggcgucauucaggacggcucuacaacgcaccgcaaugaaccccagcaaugggugcugccuagcuacuccgggagaaacguucacaaugugcaucuugccccggcugucgcccccaccuuuccuggagagcagcuccuguucuuucggagcacaaugcccggcuguucuggguauccuaacauggaucuggacugccugcucccccaggagugggugcagcacuucuaccaagaagcggcuccugcccaguccgauguggcccugcuucgcuuuguuaaucccgacaccggaagaguccuguucgaguguaagcuccauaaaagcggcuaugugacaguggcucacaccgggcagcacgaucuggucaucccgccuaacggcuacuuucgguucgacucuugggugaaccaguucuauacgcuugcccccaugggaaauggcaccgggagacgccgguga

SEQ ID NO: 29335 - RNA, 1617 nt, Artificial Sequence
  derived and/or modified sequence opt5 from VP1__Norovirus_and/or_Norovirus-like__HQ005292
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucuagaaacuacaccaugaaucucgcuacccagaacuggaacuccuaugaucccacagaggaaauuccugcgccccugggcacgccggacuucguggggaaaauccagggaguccuuacccagacaacccgggccgacggcagcacacgcgggcacaaggcuaccguguacacgggauccgccgauuuuucuccuaagcugggcagaguucaauucgccacagacaccgauaaugacuuugaugcuaaucagaacaccaaauucacacccgugggggucauucaggacggaaauaccgcccaucggaacgagccccaacagugggugcucccuagcuacuccggccgcaauagccacaacguucaccuggcgccggcuguggcccccacauuuccuggcgaacagcuucuguucuuuagaucuacgaugcccggguguuccggauauccuaauauggaucucgacugccugcugccccaggaguggguccaauacuucuaucaggaagccgcuccugcccagagcgauguggcucuccugcgguuugugaaccccgacaccggcagaguucuuuucgaguguaagcugcauaaaucuggguacgucacaguggcccacaccggacagcaugaucucgugaucccgccuaacggcuauuuucgcuucgacagcugggucaaucaauucuacacacuggcgcccauggggaacggcaccggacggagacgcuga

SEQ ID NO: 29336 - RNA, 1617 nt, Artificial Sequence
  derived and/or modified sequence opt5 from VP1__Norovirus_and/or_Norovirus-like__HQ456321
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacagugaaucucgcuagccagaacuggaauaacuaugaucccacggaggaaauuccugcgccccugggcaccccggacuucgucgggaaaauccagggagugcuuacacaaaccacaagacgggacggcucuacccgcgggcacaaggccacgguuuccacaggaagcgugcauuuuaccccuaagcugggcuccguccaguucucuaccgauacaagcaaugacuuugagaccgggcagaacacaagauucacgcccgugggaguugugcaagauggcuccaccacacaccagaaugaaccccagcaguggguccucccuaacuacagcggccgggacucucacaaugugcaucuggcuccggccguggcccccaccuuuccuggggagcaacuucuguucuuucgcuccacaaugcccggauguagcggcuacccuaacaugaaucucgauugccugcugccccaggaauggguucagcacuucuaucaggagucugcuccugcccaaagcgacgucgcgcuccugagauuugugaaccccgauaccgggcgggugcuuuucgaguguaaacugcauaaguccggauacgucacgguggcucacaccggccagcacgaccucguuauuccgccuaacggguauuuuagauucgauucuugggugaaucaguucuacacacuggcccccaugggcaacggagccggccgccggagauga

SEQ ID NO: 29337 - RNA, 1617 nt, Artificial Sequence
  derived and/or modified sequence opt5 from VP1__Norovirus_and/or_Norovirus-like__AB541326
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucaccggcagcagaaauuacaccaugaaccucgcuucucugaauuggaacaauuaugauccuacagaggaaauucccgcgccucuuggcacgcccgacuucguggggaaaauccagggaguccugacccagacaaccaagggcgacggguccacacggggacacaaggccaccguguacacgggcagcgcugauuuuacaccgaaacucggguccguucaguucgccaccgacaccgagaacgauuuugaaacacaucaaaauaccaaguucacaccugugggagucauucaggacggcggcacgacccaccgcaacgagccccagcaaugggugcugcccucuuacagcgggagaaauguucacaacgugcaucuugccccugcugucgccccgaauuuucccggagaacagcuccuguucuuucgguccacaaugccuggcuguagcggguaucccaacauggaucuggacugccugcucccucaggagugggugcagcacuucuaccaagaggcggcucccgcccagucugauguggcccugcuucgcuuuguuaacccugacaccggaagaguccuguucgaauguaaacuccauaaguccggcuaugugacaguggcucacaccgggcagcacgaucuggucauucccccgaauggcuacuuucgguucgacagcugggugaaccaguucuauacgcuugccccuaugggaaauggcaccgggagacgccgguga

SEQ ID NO: 29338 - RNA, 1617 nt, Artificial Sequence
  derived and/or modified sequence opt5 from VP1__Norovirus_and/or_Norovirus-like__AB541251
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgugucccugaacuggaauaacuaugacccuaccgaagagauucccgcgccucuuggcacacccgauuucgucgggaaaauccagggagugcugacgcagaccacaaagggcgacgggagcacccggggacacaaggccacaguuuacaccggcuccgcuccguuuacgccuaaacucgggucugugcaguucagcacagacaccgaaaaugauuuugagacccaucaaaacacaaaguucacccccgucggagugauucaggacggcuccacaacgcaccgcaaugaaccccagcaauggguucugccuagcuacucuggcagaaacgugcacaauguccaucuugccccggccguggcucccaccuuuccuggggagcagcuccuguucuuucgguccacaaugcccggauguagcggcuauccuaacauggaucuggacugccugcucccccaggagugggugcagcacuucuaccaagaagccgcgccugcucagucugauguugcccugcuucgcuuugucaaucccgacaccgggagagugcuguucgaguguaaacuccauaagagcggauaugugacagucgccuacaccggccagcacgaucuggugaucccgccuaacggguauuuucgguucgacuccuggguuaaccaguucuacacgcuugcucccaugggcaauggaaccggcagacgccgguga

SEQ ID NO: 29339 - RNA, 1617 nt, Artificial Sequence
  derived and/or modified sequence opt5 from VP1__Norovirus_and/or_Norovirus-like__AB541241
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaaucgagucucgcaccaaaccuuucacggugcccauucugaccguugaagagaugacaaacuccagauuuccuaucccccuugagaagcuguucaccgggccgagcggagccuucgugguccagccucagaauggccgguguacaaccgacggggugcuccugggaacgacacaacugucucccguuaacaucugcaccuuucgcggcgaugugacacauauugcuggcuccagagacuacaccaugaaucucgcgagccugaacuggaauaacuaugauccuaccgaagagauccccgccccucuugggacacccgacuucgucggaaaaauucagggcgugcugacgcagaccacaaagggggacggaucuacccggggccacaaggcuacagucuacaccggguccgccccguuuacgccuaaacucggaagcgugcaguucuccacagauaccgaaaaugacuuugagacccaucaaaacacaaaguucacccccguuggcgugauccaggauggcucuacaacgcaccgcaaugaaccccagcaauggguccugccuagcuacuccgggagaggagugcacaacguucaucuugccccggcuguggcccccaccuuuccuggcgagcagcuccuguucuuucggagcacaaugcccggguguucuggauauccuaauauggaccuggauugccugcucccccaggaguggguccagcacuucuaccaagaagcggcuccugcccaguccgacguggcccugcuucgcuuugugaaccccgauaccggcagaguucuguucgaguguaaacuccauaagagcggguaugucacaguggcucacaccggccagcacgaccuggugauuccgccuaauggauacuuucgguucgauucuugggucaaccaguucuauacgcuugcccccaugggcaacgggaccggaagacgccgguga

SEQ ID NO: 29340 - RNA, 1617 nt, Artificial Sequence
  derived and/or modified sequence opt5 from VP1__Norovirus_and/or_Norovirus-like__AB541216
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccgacuuuacgccgaaacucggguccguucaguucucuacagauaccgaaaacgacuuugagacccaucaaaauacaaaguucaccccugugggagucauucaggauggcggcacaacgcaccgcaacgaaccccagcaaugggugcugcccagcuacuccgggagaaauguucacaacgugcaucuugccccugcugucgccccgaccuuucccggagagcagcuccuguucuuucggagcacaaugccuggcuguucuggguaucccaauauggaccuggauugccugcucccucaggagugggugcagcacuucuaccaagaagcggcucccgcccaguccgacguggcccugcuucgcuuuguuaacccugauaccggaagaguccuguucgaguguaaacuccauaagagcggcuaugugacaguggcucacaccgggcagcacgaccuggucauucccccgaacggcuacuuucgguucgauucuugggugaaucaguucuauacgcuugccccuaugggaaacggcaccgggagacgccgguga

SEQ ID NO: 29341 - RNA, 1617 nt, Artificial Sequence
  derived and/or modified sequence opt5 from VP1__Norovirus_and/or_Norovirus-like__EU876885
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcccugccaauaucugcaccuuuagaggagacgugacacauaucgcuggcacccaggaguacaccaugaaccucgcgucucagaauuggaacaauuaugaucccacagaagagauuccugcuccccugggcacgccggacuucgucgggaagauccagggagugcuuacccaaacaacccggcgcgacggcuccacaagagggcacaaagccaccgucagcacgggauccgugcauuuuacaccuaagcugggccggauucaguucucuaccgauaccagcaacgacuuugaaacagggcagaauacccgcuucacacccguuggagugguccaagauggcggcacgacccaccagaacgagccccagcagugggugcucccuaauuacuccgggagagacggacacaacguucaucuggccccggccguggcucccagcuuuccuggcgaacaacuucuguucuuucggucuacaaugcccggguguuccggauacccuaauaugaaccucgauugccugcugccccaggaguggguccagcacuucuaucaggaggccgcgccugcucaaagcgacguggcccuccugagauuugugaaucccgauaccggccgcguucuuuucgaauguaagcugcauaaaucuggguacgucacaguggcccacaccggccagcacgaccucgugaucccgccuaacggauauuuucgguucgauagcugggucaaccaguucuacacgcuggcucccaugggcaaugggaccggaagacgccgguga

SEQ ID NO: 29342 - RNA, 1617 nt, Artificial Sequence
  derived and/or modified sequence opt5 from VP1__Norovirus_and/or_Norovirus-like__AB447435
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaacucaacgacucuaccauuaagcugaucgccaugcuuuauacaccccugcgcgcuaacaaugccggcgaagauguuuucaccgugagcugcagagugcucacacggcccuccccugacuuugauuucauuuuucuggucccgcccaccguggagagccgcacgaaaccuuucaccguucccauccuuacaguggaagagaugaccaacucuagauuuccuauuccccuggagaaacucuucacagggccguccggagccuucgucgugcagccucagaauggccgguguaccacggacgggguucugcugggaacaacccagcucagccccgugaacaucugcacauuucgcggcgaugucacccauaucgcuggcucuagaaauuacaccaugaaccuggcgucccuuaauuggaacaauuaugacccuacagaagagauucccgccccucuggggacgcccgauuucgugggaaagauccaaggcguccucacccagacaaccaagggggacggaagcacacggggccacaaggcuaccguguacacggggucugccccguuuacaccuaaacugggauccguucaguucagcaccgacaccgaaaacgauuuugagacacaucagaauaccaaguucacacccgugggcgucauucaagacggcuccacgacccaccgcaacgaaccccagcagugggugcuuccuucuuacagcgggagaaauguucacaacgugcaucuggccccggcugucgcccccacauuuccuggagagcaacuccuguucuuucgguccaccaugcccggcuguagcggguauccuaauauggaucuggacugccuccugccccaggagugggugcagcacuucuaccaggaagcggcuccugcccaaucugauguggcccuucugcgcuuuguuaaccccgacacaggaagaguccucuucgaguguaaacugcauaaguccggcuaugugaccguggcucacacggggcagcacgaucuugucaucccgccuaacggcuacuuucgguucgacagcugggugaaucaguucuauacccuggcccccaugggaaacggcacagggagacgccgguga

SEQ ID NO: 29343 - RNA, 1617 nt, Artificial Sequence
  derived and/or modified sequence opt5 from VP1__Norovirus_and/or_Norovirus-like__KX354073
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucgccacagacaccgagaacgauuuugaaacccaucaaaauacacgcuucaccccugugggagucauucaggacggcucuacaacgcacagaaacgagccccagcaaugggugcugcccagcuacuccggccggaauguucacaacgugcaucuugcuccugccgucgcgccgaauuuucccggggaacagcuccuguucuuucgcagcaccaugccuggauguucuggcuaucccaacauggaucuggacugccugcucccucaggagugggugcagcacuucuaccaagaggcugcccccgcccaguccgauguggcucugcuuagauuuguuaacccugacacagggcggguccuguucgaauguaagcuccauaaaagcggauaugugaccguggcccacacaggccagcacgaucuggucauucccccgaauggguacuuuagauucgacucuugggugaaccaguucuauacccuugcuccuaugggcaauggaacgggccgccggagauga

SEQ ID NO: 29344 - RNA, 1617 nt, Artificial Sequence
  derived and/or modified sequence opt5 from VP1__Norovirus_and/or_Norovirus-like__KX353981
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguucagaacgugcaccuugccccggcugucgcccccaccuuuccuggagagcagcuccuguucuuucggagcacaaugcccggcuguucuggguauccuaauauggaucuggacugccugcucccccaggagugggugcaacauuucuaccaggaagcggcuccugcccaguccgauguggcccugcuucgcuuuguuaaccccgacaccggaagaguccuguucgaguguaaacuccacaagagcggcuaugugacaguggcucauaccgggcagcacgaucuggucaucccgccuaacggcuacuuucgguucgacucuugggugaaucaauucuauacgcuugcccccaugggaaacggcaccgggagacgccgguga

SEQ ID NO: 29345 - RNA, 1617 nt, Artificial Sequence
  derived and/or modified sequence opt5 from VP1__Norovirus_and/or_Norovirus-like__KU182479
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcgcucagaacuacaccaugaaucucgcgagccagaacuggaauaacuaugaucccacagaggaaauuccugcuccccugggcacgccggacuucguggggaaaauccagggaguccuuacccaaacaaccagacgggacggcucuacacgcgggcacaaggccaccguguccacgggaagcguucauuuuacaccuaagcugggcuccgugcaguucucuaccgauaccagcaaugacuuugagacagggcagaacaccagauucacacccgucggagugguucaagauggcuccacgacccaccagaaugaaccccagcagugggugcucccugacuacagcggccgggauucucacaacguccaucuggccccggccguggcucccacauuuccuggggagcaacuucuguucuuucgcuccaccaugcccggauguagcggcuacccuaauaugaaccucgacugccugcugccccaggaaugggugcagcacuucuaucaggagucugccccugcgcaaagcgauguugcucuccugagauuugucaaucccgacacagggcgggugcuuuucgaguguaaacugcauaaguccggauacgugaccgucgcccacacgggccagcacgaucucgugauuccgccuaacggguauuuuagauucgacucuuggguuaaccaguucuacacccuggcccccaugggcaauggagcuggccgccggagauga

SEQ ID NO: 29346 - RNA, 1617 nt, Artificial Sequence
  derived and/or modified sequence opt5 from VP1__Norovirus_and/or_Norovirus-like__KU182478
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaagauucacgcccgucggagugguucaagauggcuccaccacacaccagaaugaaccccagcagugggugcucccugacuacagcggccgggauucucacaacguccaucuggcuccggccguggcccccaccuuuccuggggagcaacuucuguucuuucgcuccacaaugcccggauguagcggcuacccuaauaugaaccucgacugccugcugccccaggaaugggugcagcacuucuaucaggagucugcuccugcccaaagcgauguugcgcuccugagauuugucaaucccgacaccgggcgggugcuuuucgaguguaaacugcauaaguccggauacgugacggucgcucacaccggccagcacgaucucgugauuccgccuaacggguauuuuagauucgacucuuggaucaaccaguucuacacacuggcccccaugggcaauggagccggccgccggagauga

SEQ ID NO: 29347 - RNA, 1617 nt, Artificial Sequence
  derived and/or modified sequence opt5 from VP1__Norovirus_and/or_Norovirus-like__AB972501
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucggaacagacaccgaaaacgauuuugagacccaucaaaauacaaaguucacccccgugggcgucauucaggacggcgggacaacgcaccgcaacgaaccccagcaaugggugcugccuucuuacagcggaagaaauguuccgaacgugcaccuugcccccgcugucgccccuaccuuucccggcgagcagcuccuguucuuucgguccacaaugccuggguguagcggauaucccaauauggaucuggacugccugcucccucaggagugggugcagcauuucuaccaagaagcggcucccgcccagucugauguggcccugcuucgcuuuguuaacccggacaccggcagaguccuguucgaguguaaacuccacaagccuggguaugugacaguggcucauaccggccagcacgaucuggucauucccccuaacggauacuuucgguucgacuccugggugaaucaguucuauacgcuugcccccaugggcaacgggaccggaagacgccgguga

SEQ ID NO: 29348 - RNA, 1617 nt, Artificial Sequence
  derived and/or modified sequence opt5 from VP1__Norovirus_and/or_Norovirus-like__KR904214
augaagauggccagcuccgacgcuaaccccucugugggcagcgccgcgaaucuggucccugagguuaacaaugaagugauggcucucgagccgguggucggggccgccaucgcugcccccguggcuggacagcaaaacguuauugauccuuggaucagaaauaacuucgugcaggcccccggcggggaauuuaccgucuccccucggaaugcgcccggagagauucuguggucugccccucuuggcccggaccugaaccccuaccucagccaccuggcucgcauguauaauggguacgccggaggcuucgaagugcuuguuauccuggcuggcaacgccuuuacagcggggaaaauuaucuucgccgcugugccucccaauuuuccuacggagggacucucccccucucaggucaccauguucccgcauaucauuguggaugugagacagcuggagccuguccugaucccccucccugacguucggaacaauuuuuaucacuacaaccaaagcaaugaucccacaauuaagcugaucgccaugcuuuauacaccccugcgcgcuaacaacgccggcgacgauguguucaccguguccugcagaguccucacccggccuagcccggacuuugauuucauuuuucuggugcccccuacaguugaaucucgcaccaaacccuucuccgugccuauccuuacggucgaggaaaugaccaauagcagauuucccauuccgcuggagaagcuguucacagggccuucuuccgccuucgugguucagccccagaacggacgguguaccacagacggcgugcugcuggggaccacgcagcucagcccugucaauaucugcacauuucgcggagaugugacccauacaaccggcucucacaacuacaccaugaaucuggcuacacaaaacuggaacuccuaugaccccacggaggaaaucccugcgccccuuggcaccccggauuucgucgggaaaauucagggagugcugacacagaccacaaagaccgacggcagcacgagagggcauaaggccacaguuuacaccggauccgcugacuuugccccuaaacucggccgggugcaguucgccaccgauacagacaaugauuuugaggcuaaucaaaacaccaaguucacacccgucggggugauccaggacggaggcacggcccaccgcaaugaaccccagcaauggguucugccuucuuacagcggcagaaacacccacaaugugcaucuugcgccggcugucgcccccacauuuccuggggagcagcuccucuucuuucgguccaccaugcccggauguagcggcuauccuaacauggaucuggacugccugcucccccaggaaugggugcaguacuucuaucaagaggccgcuccugcccagucugauguggcucugcuucgcuuuguuaaucccgacacagggagaguccuguucgaguguaaacuccacaaguccggauacgugaccguggcccauacgggcccgcacgaucuggucauuccucccaacggguauuuucgguucgacagcugggugaaccaguucuacacccuugcgccuaugggcaauggaacaggcagacgccgguga

SEQ ID NO: 29349 - RNA, 1617 nt, Artificial Sequence
  derived and/or modified sequence opt5 from VP1__Norovirus_and/or_Norovirus-like__AB933758
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucucacaacuacaccaugaaucucgcuucccagaacuggaauagcuaugaucccaccgaggaaauuccugcgccccugggcacaccggacuucguggggaaaauccagggaguccuuacgcagaccacaagaaccgacggcuccacacgggggcauaaggccaccguguacacgggaucugcugaguuuagcccuaagcugggccgcguucaauucgccacagauaccaacaaugacuuugaugccaaccagaauaccaaauucacacccgugggggucauucaggacggaggcaccacacacagaaacgaaccccaacagugggugcucccuuccuacagcggccggaauacgcacaacguucaucuggcuccggccguggcgcccaccuuuccuggggagcagcuucuguucuuucgcucuacaaugcccggauguuccggcuauccuaauauggaucucgacugccugcugccccaggaauggguccaauacuucuaucaggaggcugccccugcccagagcgauguggcucuccugagauuugugaaccccgacaccgggcggguucuuuucgaguguaagcugcacaaaucuggauacgucacaguggcccauaccggccagcacgaucucgugaucccgccuaacggguauuuuagauucgacagcugggucaaucaauucuacacgcuggcucccaugggcaacggaaccggccgccggagauga

SEQ ID NO: 29350 - RNA, 1617 nt, Artificial Sequence
  derived and/or modified sequence opt5 from VP1__Norovirus_and/or_Norovirus-like__AB933698
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuuaaaggcgaugucacacauaucgcuggcucccgcaauuacaccaugaaccucgcgagccugaauuggaacaauuaugacccuaccgaagagauucccgccccucuugggacacccgauuucgugggaaagauccagggcguccugacgcagaccacaaagggggacggaucuaccagaggccacaaagcuacaguguacaccggguccgccccguuuacgccuaagcucggaagcguucaguucuccacagacaccgaaaacgauuuugagacccaucaaaauacaaaauucacccccgugggcgucauucaggacggcgggacaacgcaccagaacgaaccccaacagugggugcugccuucuuacagcggacgggauguuccgaaugugcaccuugcccccgcugucgccccuaccuuucccggcgagcagcuccuguucuuucgcuccacaaugccuggguguagcggauaucccaacaugaaucuggacugccugcucccucaggagugggugcaacauuucuaccaggaagcggcucccgcccagucugauguggcccugcuuagauuuguuaacccggacaccggccggguccuguucgaguguaagcuccacaaauccggguaugugacaguggcucauaccggccagcacgaucuggucaucccucccaacggauacuuucgcuucgacagcugggugaaucaauucuauacgcuugccccuaugggcaacgggaccggaagacggagauga

SEQ ID NO: 29351 - RNA, 1617 nt, Artificial Sequence
  derived and/or modified sequence opt5 from VP1__Norovirus_and/or_Norovirus-like__KJ678141
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcucccacaauuacaccaugaaccucgcuagccagaauugguccaacuaugaucccaccgaggaaauuccugcgccccugggcacaccggacuucguugggaaaauccagggagugcuuacgcagaccacaagaaccaauggcucuacacgggggcauaaggccaccgucuacgcuggaagcgccaacuuugccccuaagcugggccgcgugcaauucgagacggacacagaucacgaccucgaagcuaaucagaacaccaaauuuacccccguuggggugauccaggauggaaauacaacccacagaaacgagccccaacaguggguccugccuuccuacagcggccggucuacaccgaaugugcaucuugcccccgcgguggcuccuacguuccccggcgaacagcugcucuuuuuccgcuccaccaugccuggguguagcggauaucccaacauggaccuggauugccugcucccucaggaguggguucaauacuuuuaucaggaggccgcccccgcucagucugacgucgcccugcuuagauucgugaauccggauacaggccgggugcuguuugaauguaagcuccacaaaagcggguacgucaccguggcucauacaggacagcacgaccugguuauuccucccaacggcuauuucagauuugauuccugggugaaccaauucuacacccuugccccuauggggaauggcacgggacgccggagauga

SEQ ID NO: 29352 - RNA, 1617 nt, Artificial Sequence
  derived and/or modified sequence opt5 from VP1__Norovirus_and/or_Norovirus-like__EU921347
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugcuucuggccggcaacgcuuuuacggccgggaaaaucauuuucgcggccguuccucccaauuuuccuaccgagggacucucccccucucaggugacaauguucccgcauaucaucgucgacgugagacaacuggagccugugcugauuccccucccugauguccggaacaauuuuuaucacuacaaccagagcaaugaccccaccaucaagcugauugcuaugcuuuauacaccccugcgcgccaacaacgcuggcgaugacguuuucaccguguccugcagagugcucacacggccuagcccggauuuugacuucaucuuucuggugcccccuaccgucgaaucucgcacgaaacccuucuccguuccuauucuuaccguggaggaaaugacaaauagcagauuucccaucccgcuggagcggcuguucaccgggccuucuuccgccuucgucgugcagccccagaacggacgcuguacaaccgauggcguucugcuggggacgacacaacucagcccugugaauauuugcaccuuuagaggagacgucacacauaucgccggcacccaggaguacaccaugaaccuggcuucucagaauuggaacaauuaugaucccacagaagagaucccugcgccccuuggcacgccggacuucguggggaagauucagggaguccugacccaaacaacccggcgcgacggcuccacaagagggcacaaagccaccgugagcacgggauccguucauuuuacaccuaagcucggccggauccaguucucuaccgauaccagcaacgacuuugaaacagggcagaauacccgcuucacacccgugggagucgugcaagauggcggcacgacccaccagaacgagccccagcaguggguucugccugacuacuccgggagagauagccacaaugugcaucuugcuccggccgucgcccccucuuuuccuggagaacaacuccucuucuuucgguccacaaugcccggcuguagcggguacccuaacaugaaucuggacugccugcucccccaggagugggugcagcacuucuaucaggaggcugccccugcgcaaucugauguggcucugcuuagauuuguuaaccccgacaccggacgcguccuguucgaauguaagcuccauaaaagcggcuacgugacaguggcccacaccgggcagcacgaucuggucauuccgccuaauggcuauuuucgguucgacuccugggugaaccaguucuacacgcuugcccccaugggaaacggcaccgggagacgccgguga

SEQ ID NO: 29353 - RNA, 1617 nt, Artificial Sequence
  derived and/or modified sequence opt5 from VP1__Norovirus_and/or_Norovirus-like__JX459628
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcggcccugaauuggaacaauuaugacccuaccgaagagauucccgcuccucuugggacacccgauuucgugggaaaaauccagggcguccugacgcagaccacaaagggggacggaagcacccggggccacaaggccacaguguacaccgggucugccgacuuuacgccgaaacucggauccguucaguucagcacagauaccgaaaacgacuuugagacccaucaaaauacaaaguucaccccugugggcgucauucaggauggcuccacaacgcaccgcaacgaaccccagcaaugggugcugcccucuuacagcgggagaaauguucacaacgugcaucuugcuccugccgucgcgccgaccuuucccggagagcagcuccuguucuuucgguccacaaugccuggcuguagcggguaucccaauauggaccuggauugccugcucccucaggagugggugcagcacuucuaccaagaagcugcccccgcccagucugacguggcucugcuucgcuuuguuaacccugauaccggaagaguccuguucgaguguaaacuccauaaguccggcuaugugacaguggcccacaccgggcagcacgaccuggucauucccccgaacggcuacuuucgguucgauagcugggugaaucaguucuauacgcuugcuccuaugggaaacggcaccgggagacgccgguga

SEQ ID NO: 29354 - RNA, 1617 nt, Artificial Sequence
  derived and/or modified sequence opt5 from VP1__Norovirus_and/or_Norovirus-like__JQ613564
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaccgccggcucucacaacuacaccaugaaucucgcuucccagaacuggaauagcuaugaucccacagaggaaaucccugcgccccugggcacgccggacuucguggggaaaauucagggaguccuuacccagacaaccagagccgacggcuccacacgggggcauaaggcuaccguguacacgggaucugccgaguuuagcccuaagcugggccgcguucaauucgccacagauaccgacaacgauuuugacgcuaaucagaacaccaaauucacacccgugggggucauccaggauggaggcaccacacacagaaaugaaccccaacagugggugcucccuuccuacagcggccggaacacgcacaauguucaucuggccccggcgguggcucccaccuuuccuggggagcagcuucuguucuuucgcucuacaaugcccggauguuccggcuauccuaacauggaccucgauugccugcugccccaggaauggguccaauacuucuaucaggaggccgccccugcucagagcgacguggcccuccugagauuugugaaucccgauaccgggcggguucuuuucgaguguaagcugcacaaaucuggauacgucacaguggcucauaccggccagcacgaccucgugauuccgccuaacggguauuuuagauucgauagcugggucaaccaauucuacacgcuggcccccaugggcaauggaaccggccgccggagauga

SEQ ID NO: 29355 - RNA, 1617 nt, Artificial Sequence
  derived and/or modified sequence opt5 from VP1__Norovirus_and/or_Norovirus-like__GQ845332
augaagauggccagcaacgacgcuaaucccuccaacggcucugccgcgaaucuggugccugaggucaacaaugaaguuauggcucucgagccgguggugggggccgccaucgcugcccccgucgcuggacagcaaaacgugauugauccuuggaucagaaauaacuucguucaggcccccggcggggaauuuaccgugagcccucggaaugcgcccggagagauucugugguccgccccucuuggcccggaccugaaccccuaccucucucaccuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcauaucauugucgaugugagacaacucgagccugugcugaucccccugccugacguccggaacaauuuuuaucacuacaaccagucuaacgauagcacaauuaagcucaucgccaugcuguauacaccccuucgcgcuaauaacgccggcgaagacguuuucaccguguccugcagagugcugacccggcccagcccugauuuugacuucauuuuucucgucccgcccacaguggagucucgcaccaaaccuuucacgguucccauccugaccguggaagagaugacaaauuccagauuuccuauuccccuugagaagcuguucaccgggccgagcucugccuucgucgugcagccucagaacggacgguguacaaccgauggcguucuccuggggacgacacaacugucccccgugaauaucugcaccuuucgcggagacgucacacauaucgcuggcagcagaaacuacaccaugaaucucgcgucucugaacuggaauaacuaugauccuaccgaagagauucccgccccucuuggcacacccgacuucguggggaaaauccagggaguccugacgcagaccacaaagggcgauggguccacccggggacacaaggcuacaguguacaccggcagcgccccguuuacgccuaaacucggguccguucaguucucuacagacaccgaaaaugacuuugagacccaucaaaacacaaaguucacccccgugggagucauucaggauggcggcacaacgcaccgcaaugaaccccagcaaugggugcugccuagcuacuccgggagaaacguuccgaaugugcaccuugcccccgcugucgccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguggcccugcuucgcuuuguuaacccggauaccggaagaguccuguucgaguguaaacuccacaagagcggcuaugugacaguggcucauaccgggcagcacgaccuggucaucccucccaauggcuacuuucgguucgauucuugggugaaccaguucuauacgcuugccccuaugggaaauggcaccgggagacgccgguga

SEQ ID NO: 29356 - RNA, 1617 nt, Artificial Sequence
  derived and/or modified sequence opt5 from VP1__Norovirus_and/or_Norovirus-like__GQ856461
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucauggggaaaauccagggagugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcggcacaacgcaccgcaacgaaccccagcaauggguccugccuagcuacuccgggagaaaugugccgaacguucaccuugcccccgcuguggccccuaccuuucccggagagcagcuccuguucuuucggagcacaaugccuggcuguucuggguaucccaauauggaucuggacugccugcucccucaggaguggguccagcauuucuaccaagaagcggcucccgcccaguccgauguggcccugcuucgcuuugugaacccggacaccggaagaguucuguucgaguguaaacuccacaagagcggcuaugucacaguggcucauaccgggcagcacgaucuggugaucccucccaacggcuacuuucgguucgacucuugggucaaucaguucuauacgcuugccccuaugggaaacggcaccgggagacgccgguga

SEQ ID NO: 29357 - RNA, 1617 nt, Artificial Sequence
  derived and/or modified sequence opt5 from VP1__Norovirus_and/or_Norovirus-like__AB541245
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagauaucacacauauugcuggcagcagaaauuacaccaugaaccucgcgucucugaauuggaacaauuaugacccuaccgaagagauccccgccccucuuggcacacccgauuucgucgggaaaauucagggagugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauccaggacggcagcacaacgcaccgcaacgaaccccagcaauggguccugccuuccuacagcggcagaaaugcccacaacgugcaucuugcuccggccguugcgcccaccuuuccuggggagcagcuccuguucuuucggucuacaaugcccggauguuccggcuauccuaauauggaucuggacugccugcucccccaggagugggugcagcacuucuaccaagaagcugccccugcccagagcgaugucgcucugcuucgcuuugugaaccccgacaccgggagagugcuguucgaguguaaacuccauaagucuggauauguuacagucgcccacaccggccagcacgaucuggugauuccgccuaacggguacuuucgguucgacagcugggugaaucaguucuauacgcuugcucccaugggcaacggaaccggcagacgccgguga

SEQ ID NO: 29358 - RNA, 1617 nt, Artificial Sequence
  derived and/or modified sequence opt5 from VP1__Norovirus_and/or_Norovirus-like__AB541229
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaauguucagaacgugcaccuugccccggcugucgcccccaccuuuccuggggagcagcuccuguucuuucggucuacaaugcccggauguuccggcuauccuaauauggaucuggacugccugcucccccaggagugggugcaacauuucuaccaggaagcggcuccugcccagagcgauguggcccugcuucgcuuuguuaaccccgacaccgggagaguccuguucgaguguaaacuccacaagucuggauaugugacaguggcucauaccggccagcacgaucuggucaucccgccuaacggguacuuucgguucgacagcugggugaaucaauucuauacgcuugcccccaugggcaacggagcuggcagacgccgguga

SEQ ID NO: 29359 - RNA, 1617 nt, Artificial Sequence
  derived and/or modified sequence opt5 from VP1__Norovirus_and/or_Norovirus-like__AB541226
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacauuaugaaccucgcgucucugaauuggaacaauuaugacccuaccgaagagauccccgccccucuuggcacccccgauuucguggggaaaauucagggaguccugacacagacgaccaagggcgacggguccacacggggacacaaggcuaccguguacacaggcagcgccccguuuaccccuaaacucggguccguucaguucucuacggacacagaaaacgauuuugagacccaucaaaauaccaaguucacacccgugggagucauccaggacggcagcaccacacaccgcaacgaaccccagcaaugggugcugccuuccuacagcggcagaaauguucacaacgugcaucuugccccggcugucgcccccacguuuccuggggagcagcuccuguucuuucggucuaccaugcccggauguuccggcuauccuaauauggaucuggacugccugcucccccaggagugggugcagcacuucuaccaagaagcggcuccugcccagagcgauguggcccugcuucgcuuuguuaaccccgacacagggagaguccuguucgaguguaaacuccauaagucuggauaugugaccguggcucacacaggccagcacgaucuggucauuccgccuaacggguacuuucgguucgacagcugggugaaucaguucuauacccuuacgcccaugggcaacggaaccggcagacgccgguga

SEQ ID NO: 29360 - RNA, 1617 nt, Artificial Sequence
  derived and/or modified sequence opt5 from VP1__Norovirus_and/or_Norovirus-like__DQ078814
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagaggugcugagccccucccaggucaccauguucccgcauaucauuguggacgugagacaacucgagccuguccugaucccccugccugauguucggaacaaucucuaucacuacaaccagucuaaugaccccacaauucgccugaucgcuaugcuuuauacaccccugagagccaacaacgcuggagaugacguguuuaccgugagcugccggguccucacccgcccuuccccggauuucgacuuuauuuuccuggugcccccuacgguugaaagcagaaccaagcccuuuucugugccuauccuuacagucgaggaaaugaccaauucccgguuccccauuccgcuggagaaacucuuuacaggcccuagcucugccuucgugguucagccccagaacgggcgcuguaccacggauggagugcugcugggcacaacccaacucuccccugucaauaucugcacauucagaggggacgugacccauaucgccggaacccagaacuacacaaugaaucuggcuagccagaacuggaauaacuaugaucccacggaggaaauuccugcgccccuuggcaccccggacuuugucggccggauccagggggugcugacacaaaccacacgcagagacggaucuacccggggccacaaggccacgguuuccacagggagcgugcauuucaccccuaaacucggauccguccaguuuucuaccgauacaagcaaugacuucgagaccggccagaacacacgcuuuacgcccguggggguugugcaagauggauccaccacacaccagaaugaaccccagcaguggguccugccugacuacagcggcagagauucucacaacgugcaucuugcuccggccguggcccccaccuucccuggcgagcaacugcucuuuuuccgguccacaaugcccggguguagcggauacccuaauaugaaccuggacugccugcucccccaggaauggguucagcacuuuuaucaggagucugcuccugcccaaagcgaugucgcgcugcuuagauucgugaaucccgacaccggccgcgugcuguuugaguguaagcuccauaaguccggguacgucacgguggcucacaccggacagcacgaucugguuauuccgccuaacggcuauuuccgguuugacucuugggugaaccaguucuacacacuugcccccauggggaauggcgccggaagacgccgguga

SEQ ID NO: 29361 - RNA, 1617 nt, Artificial Sequence
  derived and/or modified sequence opt5 from VP1__Norovirus_and/or_Norovirus-like__EU078416
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucuccguucccauccugacgguggaagagaugaccaacagcagauuuccuauuccccuugagaagcuguucacagggccgucuuccgccuucgucgugcagccucagaauggacgguguaccacagacggcguucuccuggggaccacgcaacugagccccgugaacaucugcacauuucgcggagaugucacccauaucgcuggcacacaggaauacaccaugaaucucgcgucucagaacuggaauaacuaugacccuaccgaggaaauucccgccccucugggcacacccgauuucguggggaaaauccagggaguccuuacgcaaaccacaagacgggacggcuccacccgcgggcacaaggcuacagugagcaccggauccguucauuuuacgccgaagcugggcagaauccaguucucuacagacaccagcaaugauuuugagaccgggcagaacacacgguucaccccugugggagucgugcaagacggcuccacaacgcaccagaaugaaccccagcaguggguucuccccaacuacagcggccgcgauucucacaaugugcaucuggccccugccgucgcuccguccuuucccggggagcaacuucuguucuuuagaagcaccaugccuggauguucuggcuaccccaacauggaccucgauugccugcugccucaggagugggugcagcacuucuaucaggaagccgcgcccgcucaaagcgacguggcccuccugcgguuuguuaauccugauacagggagaguccuuuucgaguguaaacugcauaaguccggauacgugaccguggcccacacaggccagcacgaccucgucauucccccgaacggguauuuucgcuucgauucuugggugaaccaguucuacacccuggcuccuaugggcaauggaacgggccggagacgcuga

SEQ ID NO: 29362 - RNA, 1617 nt, Artificial Sequence
  derived and/or modified sequence opt5 from VP1__Norovirus_and/or_Norovirus-like__EU839590
augaagauggccagcaacgacgcuaaucccuccggcgggucugccgcgaaccuggugccugaggucaauaacgaaguuauggcucucgagccgguggugggagccgccaucgcugcccccgucgcuggccagcaaaaugugauugauccuuggaucagaaacaauuucguucaggcccccgggggagaauuuaccgugagcccucggaacgcgcccggcgagauucugugguccgccccucuugggccggaccugaaucccuaccucucucaccuggcucgcauguauaacggauacgccggcggcuucgaaguccaggugauccuugcugggaaugccuuuacagcgggaaaaauuaucuucgccgcuguuccucccaacuuuccuacggagggccugagccccucccaggugaccauguucccgcauaucauugucgaugugagacaacucgagccugugcugaucccccugccugacguccggaauaacuuuuaucacuacaaucagucuaacgauagcacaauuaagcucaucgccaugcuguauacaccccuucgcgcuaacaaugccggggaagacguuuucaccguguccugcagagugcugacccggcccagcccugauuuugacuucauuuuucucgucccgcccacaguggagucucgcaccaaaccuuucacgguucccauccugaccguggaagagaugacaaacuccagauuuccuauuccccuugagaagcuguucaccggaccgagcucugccuucgucgugcagccucagaauggccgguguacaaccgaugggguucuccugggaacgacacaacugucccccgugaacaucugcaccuuucgcggcgacgucacacauaucgcuggcagcagaaauuacaccaugaaccucgcgucucugaauuggaacaauuaugauccuaccgaagagauucccgccccucuugggacacccgacuucgugggaaaaauccagggcguccugacgcagaccacaaagggggauggauccacccggggccacaaggcuacaguguacaccgggagcgccccguuuacgccuaaacucggauccguucaguucucuacagacaccgaaaacgacuuugagacccaucaagauacaaaguucacccccgugggcgucauucaggacggcgggacaacgcaccgcaaugaaccccagcaaugggugcugccuagcuacuccggaagaaacguucagaaugugcaccuugccccggcugucgcccccaccuuuccuggcgagcagcuccuguucuuucggagcacaaugcccggguguucuggauauccuaacauggaucuggacugccugcucccccaggagugggugcaacauuucuaccaggaagcggcuccugcccaguccgauguggcccugcuucgcuuuguuaaucccgacaccggcagaguccuguucgaguguaaacuccacaagagcggguaugugacaguggcucauaccggccagcacgaucuggucaucccgccuaacggauacuuucgguucgacucuugggugaaccaauucuauacgcuugcccccaugggcaaugggaccggaagacgccgguga

SEQ ID NO: 29363 - RNA, 1617 nt, Artificial Sequence
  derived and/or modified sequence opt5 from VP1__Norovirus_and/or_Norovirus-like__AB294783
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagaggcgacgggucuacccggggacacaaggccacgguguccacaggcagcguucauuuuaccccuaagcugggguccgugcaguucucuaccgauacaagcaaugacuuugagaccggacagaacacacgcuucacgcccgucggcgugguucaagauggcuccaccacacaccagaaugaaccccagcagugggugcucccuaacuacagcgggagagacucucacaauguccaucuggcuccggccguggcccccaccuuuccuggagagcaacuucuguucuuucgguccacaaugcccggcuguagcggguacccuaacaugaaucucgauugccugcugccccaggaaugggugcagcacuucuaucaggagucugcuccugcccaaagcgacguugcgcuccugcgcuuugucaaccccgauaccggaagagugcuuuucgaguguaaacugcauaaguccggcuacgugacggucgcucacaccgggcagcacgaccucgugauuccgccuaacggcuauuuucgguucgauucuuggguuaaucaguucuacacacuggcccccaugggaaacggcgccgggagacgccgguga

SEQ ID NO: 29364 - RNA, 1617 nt, Artificial Sequence
  derived and/or modified sequence opt5 from VP1__Norovirus_and/or_Norovirus-like__AB303941
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcauucauuuuaccccuaagcugggcuccguucaguucucuaccgauacaagcaaugacuuugagaccgggcagaacacaagauucacgcccgugggagucgugcaagauggcuccaccacacaccagaaugaaccccagcaguggguucucccugacuacagcggccgggauucucacaacgugcaucuggcuccggccgucgcccccaccuuuccuggggagcaacuucuguucuuucgcuccacaaugcccggauguagcggcuacccuaauaugaaccucgacugccugcugccccaggaaugggugcagcacuucuaucaggagucugcuccugcccaaagcgauguggcgcuccugagauuuguuaaucccgacaccgggcggguccuuuucgaguguaaacugcauaaguccggauacgugacgguggcucacaccggccagcacgaucucgucaucccgccuaacggguauuuuagauucgacucuugggugaaccaguucuacacacuggcccccaugggcaauggagccggccgccggagauga

SEQ ID NO: 29365 - RNA, 1617 nt, Artificial Sequence
  derived and/or modified sequence opt5 from VP1__Norovirus_and/or_Norovirus-like__EF126961
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugaggcugggcagaacaccagauucacacccgucggagugguucaagauggcuccacgacccaccagaaugaaccccagcagugggugcucccugacuacagcggccgggauucucacaacguccaucuggccccggccguggcucccacauuuccuggggagcaacuucuguucuuucgcuccaccaugcccggauguagcggcuacccuaauaugaaccucgacugccugcugccccaggaaugggugcagcacuucuaucaggagucugccccugcgcaaagcgauguugcucuccugagauuugucaaucccgacacagggcgggugcuuuucgaguguaaacugcauaaguccggauacgugaccgucgccuauacgggccagcacgaucucgugauuccgccuaacggguacuuuagauucgacucuuggguuaaccaguucuauacccuggcccccaugggcaauggagcuggccgccggagauga

SEQ ID NO: 29366 - RNA, 1617 nt, Artificial Sequence
  derived and/or modified sequence opt5 from VP1__Norovirus_and/or_Norovirus-like__LC153749
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaagacacaaaguucacccccgugggagucauucaggauggcggcacaacgcaccgcaaugaaccccagcaaugggugcugccuagcuacuccgggagagacguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagagcggcuaugugacaguggcucauaccgggcagcacgaucuggucaucccucccaauggcuacuuucgguucgacucuugggugaaccaguucuauacgcuugccccuaugggaaacggcaccgggagacgccgguga

SEQ ID NO: 29367 - RNA, 1617 nt, Artificial Sequence
  derived and/or modified sequence opt5 from VP1__Norovirus_and/or_Norovirus-like__KX371610
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgggacagacaccgaucaugacuuugaggccaaccagagcaccaaauucacacccguuggagugauccaggauggcuccaccacacaccggaaugaaccccaacaguggguccucccuagcuacucuggccgcaacacgccgaaugugcaccuggcucccgccguggcgccuaccuuucccggggagcagcuucuguucuuuagauccacaaugccuggauguagcggcuaucccaacauggaccucgauugccugcugccucaggaauggguucaauacuucuaucaggaggcugcccccgcccagucugacgucgcucuccugcgguuugugaauccggauaccgggagagugcuuuucgaguguaagcugcauaaaagcggauacgucacaguggcccacaccggccagcaugaccucguuauuccucccaacggguauuuucgcuucgauuccugggugaaucaauucuacacgcuggcuccuaugggcaacggaaccggccggagacgcuga

SEQ ID NO: 29368 - RNA, 1617 nt, Artificial Sequence
  derived and/or modified sequence opt5 from VP1__Norovirus_and/or_Norovirus-like__KX354031
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgggacagacaccgaucaugacuuugaggccaaucagaacaccaaauucacacccguuggagugauccaggauggcucuaccacacaccggaaugaaccccaacaguggguccucccuagcuacuccggccgcaacacgcacaaugugcaucuggcuccggccguggcgcccaccuuuccuggggagcagcuucuguucuuuagaagcacaaugcccggauguucuggcuauccuaacauggaccucgauugccugcugccccaggaauggguucaauacuucuaucaggaggcugccccugcccaguccgacgucgcucuccugcgguuugugaaucccgauaccgggagagugcuuuucgaguguaagcugcacaaaagcggauacgucacaguggcccauaccggccagcacgaccucguuauuccgccuaacggguauuuucgcuucgauucuugggugaaccaauucuacacgcuggcucccaugggcaauggaaccggccggagacgcuga

SEQ ID NO: 29369 - RNA, 1617 nt, Artificial Sequence
  derived and/or modified sequence opt5 from VP1__Norovirus_and/or_Norovirus-like__KX353990
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaacuccagauuucccaucccgcuugagaagcuguucaccgggccuagcucugccuucgugguucagccccagaauggacgguguacaaccgauggcgugcuccuggggacgacacaacuguccccugucaacauuugcaccuuucgcggagacgugacacauaucgccggcagcagaaauuacaccaugaaccucgcuucucagaauuggaacuccuaugaucccaccgaggaaaucccugcgccccugggcacaccggacuucgucgggaaaauucagggagugcuuacgcagaccacacggaccgacggcagcacacgcgggcacaaggccaccguuuacacgggauccgcugauuuuucuccuaagcugggcagagugcaauucgccacagacaccgauaaugacuuugagaccaaccagaauacaaaauucacccccgucggggugauccaggauggaggcacaacgcaucggaacgaaccccaacaguggguucucccuagcuacuccggccgcaauacccacaacgugcaccuggccccggcugucgcccccacauuuccuggggagcagcuucuguucuuuagaagcaccaugcccggauguucuggcuauccuaauauggaccucgauugccugcugccccaggaaugggugcaauacuucuaucaggaggcggcuccugcccaguccgacguggcccuccugcgguuuguuaaccccgauacagggagaguccuuuucgaguguaagcugcauaaaagcggauacgugaccguggcucacacgggccagcaugaccucgucauuccgccuaacggguauuuucgcuucgauucuugggugaaucaauucuacacccuggcccccaugggcaacggaacaggccggagacgcuga

SEQ ID NO: 29370 - RNA, 1617 nt, Artificial Sequence
  derived and/or modified sequence opt5 from VP1__Norovirus_and/or_Norovirus-like__KX353972
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaacuccagauuucccaucccgcuugagaagcuguucaccgggccuagcucugccuucgugguucagccccagaauggacgguguacaaccgauggcgugcuccuggggacgacacaacuguccccugucaacauuugcaccuuucgcggagacgugacacauaucaccggcagcagaaauuacaccaugaaccucgccucucagaauuggaacuccuaugaucccacagaggaaaucccugcuccccugggcacgccggacuucgucgggaaaauucagggagugcuuacccagacaacccggacagacggcagcacccgcgggcacaaggcgacgguuuacacaggauccgccgauuuuucuccuaagcugggcagagugcaauucgcuaccgacaccgauaaugacuuugagacaaaccagaauaccaaauucacacccgucggggugauccaggauggaggcacgacccaucggaacgaaccccaacaguggguucucccuagcuacuccggccgcaauacacacaacgugcaccuggccccggccgucgcucccaccuuuccuggggagcagcuucuguucuuuagaagcacaaugcccggauguucuggcuauccuaauauggaccucgauugccugcugccccaggaaugggugcaauacuucuaucaggaggccgcgccugcucaguccgacguggcccuccugcgguuuguuaaccccgauaccgggagaguccuuuucgaguguaagcugcauaaaagcggauacgugacgguggcccacaccggccagcaugaccucgucauuccgccuaacggguauuuucgcuucgauucuugggugaaucaauucuacacacuggcucccaugggcaacggaaccggccggagacgcuga

SEQ ID NO: 29371 - RNA, 1617 nt, Artificial Sequence
  derived and/or modified sequence opt5 from VP1__Norovirus_and/or_Norovirus-like__KX353968
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucgccacagacaccgagaacgauuuugaaacccaucaaaauacacgcuucaccccugugggagucauucaggacggcggcacaacgcacagaaacgagccccagcaaugggugcugcccucuuacagcgggcggaauauccacaacguucaucuugcuccugccguggcgccgaauuuucccggagaacagcuccuguucuuucgcuccaccaugccuggcuguagcggguaucccaacauggaucuggacugccugcucccucaggaguggguccagcacuucuaccaagaggcugcccccgcccagucugauguggcucugcuuagauuugugaacccugacacaggacggguucuguucgaauguaagcuccauaaauccggcuaugucaccguggcccacacagggcagcacgaucuggugauucccccgaauggcuacuuuagauucgacagcugggucaaccaguucuauacccuugcuccuaugggaaauggcacggggcgccggagauga

SEQ ID NO: 29372 - RNA, 1617 nt, Artificial Sequence
  derived and/or modified sequence opt5 from VP1__Norovirus_and/or_Norovirus-like__KX353967
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucgccacagacaccgagaacgauuuugaaacccaucaaaauacacgcuucaccccugugggagucauucaggacggcggcacaacgcacagaaacgagccccagcaaugggugcugcccucuuacagcgggcggaauauccacaacguucaucuugcuccugccguggcgccgaauuuucccggagaacagcuccuguucuuucgcuccaccaugccuggcuguagcggguaucccaacgucgaucuggacugccugcucccucaggagugggugcagcacuucuaccaagaggcugcccccgcccagucugauguggcucugcuuagauuuguuaacccugacacaggacggguccuguucgaauguaagcuccauaaauccggcuaugugaccguggcccacacagggcagcacgaucuggucauucccccgaauggcuacuuuagauucgacagcugggugaaccaguucuauacccuugcuccuaugggaaauggcacggggcgccggagauga

SEQ ID NO: 29373 - RNA, 1617 nt, Artificial Sequence
  derived and/or modified sequence opt5 from VP1__Norovirus_and/or_Norovirus-like__KX353966
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccagaucaccauguucccgcauauuaucguggacgucagacaacucgagccugugcugauuccccugccugaugugcggaauaacuuuuaucacuacaaucagucuaacgacagcacaaucaagcucauugccaugcuguauacaccccuucgcgcuaacaaugccggcgaugacgucuucaccguuuccugcagagugcugacccggcccagcccugauuuugacuucaucuuucucgugccgcccacagucgaaucucgcaccaaaccuuucacggugcccauucugaccguugaggaaaugacaaacuccagauuuccuaucccccuugagcggcuguucaccgggccgagcucugccuucgugguccagccucagaauggacgcuguacaaccgauggcgugcuccuggggacgacacaacugucccccguuaacaucugcaccuuuagaggagacgugaaucauauugcuggcagccggaacuacacaaugaaucucgcgucucugaacuggaauaacuaugauccuaccgaggaaacccccgccccucuuggcacacccgacuucgucgggaagauccagggagugcugacgcagaccacacgcggcaauggguccaccagaggacaccgggcuacagucuacaccggcagcgccgacuuuacgccgaaacucgggcgcauucaguucgccacagauaccgacaacgauuuugagacccaucaaaauacaaaguucaccccugugggaguuauccaggacggcaacacaacgcacagaaaugaaccccagcaaugggugcugcccuccuacucuggccggaacguccagaacgugcaccuugcuccugccguugcgccgaauuuucccggggagcagcuccuguucuuuagaagcaccaugccuggauguuccggcuaucccaacauggaucuggacugccugcucccucaggaaugggugcaacauuucuaccaggaggcugcccccgcccagagcgaugucgcucugcuucgcuuugugaauccugacacagggcgggugcuguucgaguguaagcuccacaaaucuggauuuguuaccgucgcccauacaggccagcacgaucuggugauucccccgaacggguauuucagauucgacuccugggugaaucaauuuuacacccuugcuccuaugggcaagggaacgggccgccggagauga

SEQ ID NO: 29374 - RNA, 1617 nt, Artificial Sequence
  derived and/or modified sequence opt5 from VP1__Norovirus_and/or_Norovirus-like__AB663684
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagagcggcuaugugacaguggcucauaccgggcagcacgaucuggucaucccucccaacggcuacuuucgguucgacucuugggugaaucaguucuauacgcuugccccuaugggaaacggcaccgggagacgccgguga

SEQ ID NO: 29375 - RNA, 1617 nt, Artificial Sequence
  derived and/or modified sequence opt5 from VP1__Norovirus_and/or_Norovirus-like__KR904209
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucucacaacuacaccaugaaucucgcuucccagaacuggaauagcuaugaucccaccgaggaaauuccugcgccccugggcacaccggacuucguggggaaaauccagggaguccuuacgcagaccacaagagccgacggcuccacccgggggcauaaggcuacaguguacaccggaucugccgauuuuagcccuaagcugggccgcguucaauucgccacggacacaaacaaugauuuugacgcuaaccagaauaccaaauucacccccgugggggucauucaggauggagagacagcccacagaaacgaaccccaacagugggugcucccuuccuacagcggccggaauauccacaacguucaucuggcgccggcuguggcccccaccuuuccuggcgagcagcuucuguucuuucgcucuacaaugcccggguguuccggauauccuaauauggaacucgacugccugauuccccaggaguggguccaauacuucuaucaggaggccgcuccugcccagagcgauguggcucugcucagauuugugaaccccgacacgggccggguucuguucgaauguaaacuucacaagucuggguacgucaccguggcccauacaggacagcacgaucuggugaucccgccuaacggcuauuuuagauucgacagcugggucaaucaauucuacacccucgcgcccauggggaacggcacaggacgccggagauga

SEQ ID NO: 29376 - RNA, 1617 nt, Artificial Sequence
  derived and/or modified sequence opt5 from VP1__Norovirus_and/or_Norovirus-like__AB933716
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagaggugcccgccccucuuggcacacccgauuucgucgggaaaauucagggagugcugacgcagaccacaaagggcgacggguccacccggggacacaaggcuacaguuuacaccggcagcgccccguuuacgccuaaacucggguccgugcaguucucuacagacaccgaaaacgauuuugagacccaucaaaauacaaaguucacccccgucggagugauccaggacggcagcacaacgcaccgcaacgaaccccagcaauggguucugccuuccuacagcggcagagaugugccgaauguccaccuugcccccgcuguggccccuaccuuucccggggagcagcuccuguucuuucggucuacaaugccuggauguuccggcuaucccaacauggaccuggauugccugcucccucaggagugggugcagcauuucuaccaagaagcggcucccgcccagagcgacguugcccugcuucgcuuugucaauccggauaccgggagagugcuguucgaguguaaacuccacaagucuggauaugugacagucgcucauaccggccagcacgaccuggugauuccucccaacggguacuuucgguucgauagcuggguuaaccaguucuauacgcuugccccuaugggcaauggaaccggcagacgccgguga

SEQ ID NO: 29377 - RNA, 1617 nt, Artificial Sequence
  derived and/or modified sequence opt5 from VP1__Norovirus_and/or_Norovirus-like__AB933666
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaagacacaaaguucacccccgugggagucauucaggauggcggcacaacgcaccgcaaugaaccccagcaaugggugcugccuagcuacuccgggagaaacguuccgaaugugcaccuugcccccgcugucgccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguggcccugcuucgcuuuguuaauccggauaccggaagaguccuguucgaguguaaacuccacaagagcggcuaugugacaguggcucauaccgggcagcacgaccuggucaucccucccaacggcuacuuucgguucgauucuugggugaaccaguucuauacgcuugccccuaugggaaauggcaccgggagacgccgguga

SEQ ID NO: 29378 - RNA, 1617 nt, Artificial Sequence
  derived and/or modified sequence opt5 from VP1__Norovirus_and/or_Norovirus-like__EU921349
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcccugugaauaucugcaccuuuagaggagacgucacacauaucgccggcacccaggaguacaccaugaaccucgcuucucagaauuggaacaauuaugaucccacagaagagauuccugcgccccugggcacgccggacuucguggggaagauccagggaguccuuacccaaacaacccggcgcgacggcuccacaagagggcacaaagccaccgugagcacgggauccguucauuuuacaccuaagcugggccggauucaguucucuaccgauaccagcaacgacuuugaaacagggcagaauacccgcuucacacccgugggagucgugcaagauggcuccacgacccaccagaacgagccccagcaguggguucucccugacuacagcggcagagauucucacaaugugcaucuggcuccggccgucgcccccuccuuuccuggggaacaacuucuguucuuucggagcacaaugcccggauguucuggcuacccuaacaugaaucucgacugccugcugccccaggagugggugcagcacuucuaucaggaggcugccccugcgcaaagcgauguggcucuccugagauuuguuaaccccgacaccgggcgcguccuuuucgaauguaagcugcauaaauccggauacgugacaguggcccacaccggccagcacgaucucgucaucccgccuaauggguauuuucgguucgacucuugggugaaccaguucuacacgcuggcccccaugggcaacggaaccggcagacgccgguga

SEQ ID NO: 29379 - RNA, 1617 nt, Artificial Sequence
  derived and/or modified sequence opt5 from VP1__Norovirus_and/or_Norovirus-like__EU921348
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcccugugaauaucugcaccuuuagaggagacgucacacauaucgccggcacccaggaguacaccaugaaccucgcuucucagaauuggaacaauuaugaucccacagaagagauuccugcgccccugggcacgccggacuucguggggaagauccagggaguccuuacccaaacaacccggcgcgacggcuccacaagagggcacaaagccaccgugagcacgggauccguuaacuuuacaccuaagcugggccggauucaguucucuaccgauaccagcaaugacuuugaaacagggcagaacacccgcuucacacccgugggagucgugcaagauggcuccacgacccaucagaaugagccccagcaguggguucucccugacuacagcggcagagauucucacaacgugcaccuggcuccggccgucgcccccuccuuuccuggggaacaacuucuguucuuucggagcacaaugcccggauguucuggcuacccuaauaugaaccucgacugccugcugccccaggagugggugcagcauuucuaucaggaggcugccccugcgcaaagcgauguggcucuccugagauuuguuaaucccgacaccgggcgcguccuuuucgaauguaagcugcacaaauccggauacgugacaguggcccauaccggccagcacgaucucgucaucccgccuaacggguauuuucgguucgacucuugggugaaccaguucuacacgcuggcccccaugggcaauggaaccggcagacgccgguga

SEQ ID NO: 29380 - RNA, 1617 nt, Artificial Sequence
  derived and/or modified sequence opt5 from VP1__Norovirus_and/or_Norovirus-like__EU921345
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcccugugaauaucugcaccuuuagaggagacgucacacauaucgccggcacccaggaguacaccaugaaccucgcuucucagaauuggaacaauuaugaucccacagaagagauuccugcgccccugggcacgccggacuucguggggaagauccagggaguccuuacccaaacaacccggcgcgacggcuccacaagagggcacaaagccaccgugagcacgggauccguucauuuuacaccuaagcugggccggauucaguucucuaccgauaccagcaacgacuuugaaacagggcagaauacccgcuucacacccgugggagucgugcaagauggcuccacgacccaccagaacgagccccagcaguggguucucccugacuacagcggcagagaugggcacaaugugcaucuggcuccggccgucgcccccucuuuuccuggagaacaacuucuguucuuucgguccacaaugcccggcuguagcggguacccuaacaugaaucucgacugccugcugccccaggagugggugcagcacuucuaucaggaggcugccccugcgcaaucugauguggcucuccugagauuuguuaaccccgacaccggacgcguccuuuucgaauguaagcugcauaaaagcggcuacgugacaguggcccacaccgggcagcacgaucucgucaucccgccuaauggcuauuuucgguucgacuccugggugaaccaguucuacacgcuggcccccaugggaaacggcaccgggagacgccgguga

SEQ ID NO: 29381 - RNA, 1617 nt, Artificial Sequence
  derived and/or modified sequence opt5 from VP1__Norovirus_and/or_Norovirus-like__KP698924
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcaucccggacuucguugggaaaauccagggagugcuuacacagacgaccagaacagacggcuccacccgggggcauaaggccacagucuacaccggaucugcugauuuugccccuaagcugggccgcgugcaauucgagacggacacaaaccacgauuuugaagccaaucagaacaccaaauucacccccguuggggugauucaggacggaggcacaacccacagaaaugagccccaacaguggguccucccuagcuacuccggccggaacacaccgaaugugcaucuggcucccgccguggcgccuacguuucccggggaacagcuucuguucuuucgcagcaccaugccuggauguucuggcuaucccaacauggaucucgacugccugcugccucaggaguggguucaacacuucuaccaggaggcugcccccgcccaguccgaugucgcucuccugagauuugugaauccggacacagggcgggugcuuuucgaauguaagcugcauaaaagcggauaugucaccguggcccacacaggccagcacgaucucguuaucccucccaacggguacuuuagauucgacucuugggugaaccaauucuauacccuggcuccuaugggcaauggaacgggccgccggagauga

SEQ ID NO: 29382 - RNA, 1617 nt, Artificial Sequence
  derived and/or modified sequence opt5 from VP1__Norovirus_and/or_Norovirus-like__LC005707
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcugacuuuacgccgaaacucgggagcguucaguucuccacagauaccgaaaaugacuuugagacccaucaaaacacaaaguucaccccugugggagucauucaggauggcucuacaacgcaccgcaaugaaccccagcaaugggugcugcccagcuacuccggcagaaacguucacaaugugcaucuugccccugcggucgcuccgaccuuucccggggagcagcuccuguucuuucggagcacaaugccuggauguucuggcuaucccaacauggaccuggauugccugcucccucaggagugggugcagcacuucuaccaagaagccgcccccgcucaguccgacguggcccugcuucgcuuuguuaauccugaucaggggagaguccuguucgaguguaaacuccauaagagcggauaugugaccguggcucacacaggccagcacgaccuggucauucccccgaacggguacuuucgguucgauucuugggugaaccaauucuauacccuugccccuaugggcaauggaacgggcagacgccgguga

SEQ ID NO: 29383 - RNA, 1617 nt, Artificial Sequence
  derived and/or modified sequence opt5 from VP1__Norovirus_and/or_Norovirus-like__KJ541743
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuaugugacaguggcucacaccgggcagcacgaucuggucaucccgccuaacggcuacuuucgguucgacucuugggugaaucaguucuauacgcuugcccccaugggaaacggcaccgggagacgccgguga

SEQ ID NO: 29384 - RNA, 1617 nt, Artificial Sequence
  derived and/or modified sequence opt5 from VP1__Norovirus_and/or_Norovirus-like__KF177443
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgggacagacaccgaucaugacuuugaggccaaucagaacaccaaauucacacccguuggagugauccaggauggcucuaccacacaccggaaugaaccccaacaguggguccucccuagcuacuccggccgcaacacgccgaaugugcaccuggcucccgccguggcgccuaccuuucccggggagcagcuucuguucuuuagaagcacaaugccuggauguucuggcuaucccaacauggaccucgauugccugcugccucaggaauggguucaauacuucuaucaggaggcugcccccgcccaguccgacgucgcucuccugcgguuugugaauccggauaccgggagagugcuuuucgaguguaagcugcauaaaagcggauacgucacaguggcccacaccggccagcaugaccucguuauuccucccaacggguauuuucgcuucgauucuugggugaaccaauucuacacgcuggcuccuaugggcaauggaaccggccggagacgcuga

SEQ ID NO: 29385 - RNA, 1617 nt, Artificial Sequence
  derived and/or modified sequence opt5 from VP1__Norovirus_and/or_Norovirus-like__JX439842
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaguguacaccaugaaccucgcgucccugaauuggaacaauuaugacccuaccgaagagauucccgccccucuuggcacacccgauuucgucgggaaaauccagggagugcugacgcagaccacaaaggaagacggcagcacccgggggcacaaggcuacaguuuacaccggauccgccccguuuacgccuaaacucggcucugugcaguucagcacagacaccgagaacgauuuugaaacccaucaaaauacaaaguucacccccgucggggugauucaggacggaggcacaacgcaccgcaacgagccccagcaauggguucugccuuccuacagcggcagaaaugccccgaacgugcaccuugcucccgccgucgcgccuaccuuucccggggagcagcuccuguucuuucggucuacaaugccuggauguuccggcuaucccaauauggaucuggacugccugcucccucaggaaugggugcagcauuucuaccaagaggcugcccccgcccagagcgauguggcucugcuucgcuuuguuaacccggacaccgggagaguccuguucgaauguaaacuccacaagucuggauaugugacaguggcccauaccggccagcacgaucuggucaucccucccaauggguacuuucgguucgacagcugggugaaccaguucuauacgcuugcuccuaugggcaacggaaccggcagacgccgguga

SEQ ID NO: 29386 - RNA, 1617 nt, Artificial Sequence
  derived and/or modified sequence opt5 from VP1__Norovirus_and/or_Norovirus-like__HF952135
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauaucuccggcagcagaaauuacaccaugaaccucgccgcucagaauuggaacuccuaugaucccaccgaggaaaucccugcgccccugggcacaccggacuucgucgggaaaauucagggagugcuuacgcagaccacaaagaccaauggcucuacacgggggcacaaggccaccguuuacacgggaagcgcugacuuuuccccuaaacugggccgcgugcaauucgccacagauaccgacaacgauuuugagaccaaucagaacacaaaguucacccccgucggggugauccaggacggaagcacaacgcccagaaaugaaccucaacaguggguucucccgucuuacuccggccggaacacccauaaugugcaccuggcccccgcugucgccccuacauuucccggcgagcagcuucuguucuuucgcagcaccaugccuggguguucuggauaucccaacauggaucucgacugccugcugccucaggaaugggugcaauacuucuaucaggaggcggcucccgcccagagcgauguggcccuccugagauuuguuaauccggacacaggccggguccuuuucgaguguaaacugcacaaguccggguacgugaccguggcucauacgggacagcacgaucucgucauuccucccaacggcuauuuuagauucgacucuugggugaaccaauucuacacccuggccccuauggggaauggcacaggacgccggagauga

SEQ ID NO: 29387 - RNA, 1617 nt, Artificial Sequence
  derived and/or modified sequence opt5 from VP1__Norovirus_and/or_Norovirus-like__JX459598
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucuguggcacgcgccucuuggcccggaucugaaccccuaccucucccaucuggcccgcauguauaauggguacgcuggaggcuucgaaguccaggugauccuugccggcaacgcuuuuaccgccgggaaaauuaucuucgcggccguuccucccaauuuuccuacagagggacugucucccagccaggugaccauguucccgcacaucauugucgacgugagacaacucgagccugugcugaucccccugccugauguccggaacaauuuuuaucauuacaaccaguccaaugaccccacaauuaagcucaucgcuaugcuguauacaccccuucgcgccaacaacgcuggcgaugacguuuucaccgugucuugcagagugcugacccggccuagcccggauuuugacuucauuuuucucgugcccccuacggucgaaucccgcaccaaacccuucagcguuccuauccugacaguggaggaaaugaccaauucuagauuucccauuccgcuugagaagcuguucacagggccuuccagcgccuucgucgugcagccccagaacggacgguguaccacggauggcguucuccuggggacaacccaacugucuccugugaauaucugcacauuucgcggagacgucacccacaucgccggcacccagaacuacacaaugaaucucgcuucccagaacuggaauaacuaugaucccacggaggaaauuccugcgccccugggcaccccggacuucguggggaaaauccagggaguccuuacacaaaccacaagacgggacggcagcacccgcgggcauaaggccacggugucuacaggauccauucacuuuaccccuaagcugggcagcguucaguucuccaccgauacaucuaaugacuuugagaccgggcagaacacaagauucacgcccgugggagucgugcaagauggcagcaccacacaccagaaugaaccccagcaguggguucucccuaacuacuccggccgggacagccauaaugugcaccuggcuccggccgucgcccccaccuuuccuggggagcaacuucuguucuuucgcucuacaaugcccggauguuccggcuacccuaacaugaaucucgauugccugcugccccaggaaugggugcagcauuucuaucaggagagcgcuccugcccaaucugacguggcgcuccugagauuuguuaaccccgauaccgggcggguccuuuucgaguguaaacugcacaagagcggauacgugacgguggcucacaccggccagcaugaccucgucaucccgccuaacggguauuuuagauucgauuccugggugaaucaguucuacacacuggcccccaugggcaacggagccggccgccggagauga

SEQ ID NO: 29388 - RNA, 1617 nt, Artificial Sequence
  derived and/or modified sequence opt5 from VP1__Norovirus_and/or_Norovirus-like__JX445162
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguucagaacgugcaccuugccccggcugucgcccccaccuuuccuggagagcagcuccuguucuuucggagcacaaugcccggcuguucuggguauccuaauauggaucuggacugccugcucccccaggagugggugcaacauuucuaccaggaagcggcuccugcccaguccgauguggcccugcuucgcuuuguuaaccccgacaccggaagaguccuguucgaguguaaacuccacaagagcggcuaugugacaguggcucauaccgggcagcacgaucugaucauuccgccuaacggcuacuuucgguucgacucuugggucaaucaauucuauacgcuugcccccaugggaaacggcaccgggagacgccgguga

SEQ ID NO: 29389 - RNA, 1617 nt, Artificial Sequence
  derived and/or modified sequence opt5 from VP1__Norovirus_and/or_Norovirus-like__JX445154
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaagauucacgcccgucggagugguucaagauggcuccaccacacaccagaaugaaccccagcagugggugcucccugacuacagcggccgggauucucacaacguccaucuggcuccggccguggcccccaccuuuccuggggagcaacuucuguucuuucgcuccacaaugcccggauguagcggcuacccuaauaugaaccucgacugccugcugccccaggaaugggugcagcacuucuaucaggagucugcuccugcccaaagcgauguugcgcuccugagauuugucaaucccgacaccgggcgggugcuuuucgaguguaaacugcauaagccgggauacgugacggucgcucacaccggccagcacgaucucgugauuccucccaacggguauuuuagauucgacuccuggguuaaccaguucuacacacuggccccuaugggcaauggagccggccgccggagauga

SEQ ID NO: 29390 - RNA, 1617 nt, Artificial Sequence
  derived and/or modified sequence opt5 from VP1__Norovirus_and/or_Norovirus-like__JX155752
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagccacaauuacgcgaugaaccucgccucucugaauuggaacaauuaugacccuaccgaagagauucccgcuccucuuggcacccccgauuucguggggaaaauccagggaguccugacacagacgaccaagggcgacggguccacaagaggacauaaggccaccauuuacacaggcagcgccccguuuaccccuaaacucggguccgugcaguucucuacggacacagaaaacgauuuugagacccaccaaaauaccaaguucacacccguuggagugauccaggacggcggcaccacacaccggaacgaaccccagcaauggguccugccuagcuacuccgggcgcaaugugccgaacguucaucuugcucccgccguggcgccuacguuucccggagagcagcuccuguucuuuagaagcaccaugccuggcuguucuggguaucccaauauggaucuggacugccugcucccucaggaguggguccagcacuucuaccaagaagcugcccccgcccaguccgauguggcucugcuucgguuugugaacccggacacaggacgcguucuguucgaguguaaacuccauaagagcggcuaucugaccgucgcccacacagggcagcacgaucuugugauuccucccaacggcuacuuuagauucgacucuugggugaaucaguucuauacccuggcuccuaugggaaacggcacggggcggagacgcuga

SEQ ID NO: 29391 - RNA, 1617 nt, Artificial Sequence
  derived and/or modified sequence opt5 from VP1__Norovirus_and/or_Norovirus-like__HM748971
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggcccugccuuccuacagcgggagaaacgugcagaauguucaccuugcuccggccguggcgcccaccuuuccuggagagcagcuccuguucuuucggucuacaaugcccggcuguuccggguauccuaacauggaucuggacugccugcucccccaggaguggguccaacauuucuaccaggaagcugccccugcccagagcgauguggcucugcuucgcuuugugaaucccgacaccggaagaguucuguucgaguguaaacuccacaagucuggcuaugucacaguggcccauaccgggcagcacgaucuggugaucccgccuaacggcuacuuucgguucgacagcugggucaaccaauucuauacgcuugcucccaugggaaauggcaccgggagacgccgguga

SEQ ID NO: 29392 - RNA, 1617 nt, Artificial Sequence
  derived and/or modified sequence opt5 from VP1__Norovirus_and/or_Norovirus-like__GQ845367
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggauaugaaccccuaccugagccaccucgcccgcauguauaauggguacgcuggaggcuucgaaguccaggugauccuggccggcaacgcuuuuacggccgggaaaauuaucuucgcggccguuccucccaauuuuccuaccgagggacuuucccccucucaggugacaauguucccgcauaucauugucgacgugagacaacuggagccugugcucaucccccugccugauguccggaacaauuuuuaucacuacaaccagagcaaugaccccaccauuaagcugaucgcuaugcucuauacaccccugcgcgccaacaacgcuggcgaugacguuuucaccguguccugcagagugcuuacacggccuagcccggauuuugacuucauuuuucuggugcccccuaccgucgaaucucgcacgaaacccuucuccguuccuauccucaccguggaggaaaugacaaauagcagauuucccauuccgcuggagaaacuuuucaccgggccuucuuccgccuucgucgugcagccccagaacggacgguguacaaccgauggcguucugcucgggacgacacaacugagcccugugaauaucugcaccuuucgcggagacgucacacauaucgccggcucuagaaacuacaccaugaaucuggcuucccagaacuggaauagcuaugaucccaccgaggaaauuccugcgccccucggcacaccggacuucguggggaagauccagggaguccugacgcagaccacacggaccgacggcuccacacgcgggcacaaggccaccguguacacgggaucugcugauuuuagcccuaaacuuggcagaguucaauucgccacagacaccgauaacgacuuugaugccaaucagaacaccaaguucacacccgugggggucauucaggacggaaauaccgcucaucggaacgagccccaacagugggugcugccuuccuacagcggccgcaauacacacaacguucaccucgccccggcgguggcucccacguuuccuggcgaacagcugcuuuucuuuagaucuaccaugcccggguguuccggauauccuaauauggaucuggacugccuccugccccaggaguggguccaauacuucuaucaggaagccgccccugcucagagcgauguggcccugcuccgguuugugaaccccgacacaggcagaguucuguucgaguguaaacuucauaagucuggguacgucaccguggcucacacaggacagcaugaucuggugaucccgccuaacggcuauuuucgcuucgacagcugggucaaucaauucuacacccucgcccccauggggaacggcacgggacggagacgcuga

SEQ ID NO: 29393 - RNA, 1617 nt, Artificial Sequence
  derived and/or modified sequence opt5 from VP1__Norovirus_and/or_Norovirus-like__GQ856455
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagcccaacgacucuacaauuaagcucaucgccaugcuguauacaccccuucgcgcuaacaaugccggcgaagauguuuucaccgugagcugcagagugcugacccggccuuccccggacuuugauuucauuuuucucgugcccccuacagucgagagccgcaccaaacccuucacgguuccuauccugaccguggaagagaugacaaacucuagauuucccauuccgcuugagaagcuguucaccgggccuuccagcgccuucgucgugcagccccagaauggacgguguacaaccgacggcguucuccuggggacgacacaacugucuccugugaacaucugcaccuuucgcggagaugucacacauaucgcuggcuccagaaauuacaccaugaaccucgcgagccugaauuggaacaauuaugaccccaccgaagagauuccugcuccccuuggcacaccggauuucguggggaaaauccagggaguccugacgcagaccacaaagggcgacgggucuacccacggacauaaggccacaguguacaccggcuccgccccuuuuacgcccaaacucgggagcguucaguucuccacagacaccgaaaacgauuuugagacccaccaaaauacaaaguucacccccgugggagucauucaggacggcucuacaacgcaccggaacgaaccucagcaaugggugcugccgagcuacuccggccgcaauguucagaacgugcaucuugcccccgcugucgccccuaccuuucccggggagcagcuccuguucuuuagaagcacaaugccuggauguucuggcuaucccaauauggaucuggacugccugcucccucaggagugggugcaacacuucuaccaggaagcggcucccgcccaguccgauguggcccugcuucgguuuguuaacccggacaccgggcgcguccuguucgaguguaaacuccauaagagcggauaugugacaguggcucacaccggccagcacgaucuggucaucccucccaacggguacuuuagauucgacucuugggugaaucaauucuauacgcuugccccuaugggcaacggaaccggccggagacgcuga

SEQ ID NO: 29394 - RNA, 1617 nt, Artificial Sequence
  derived and/or modified sequence opt5 from VP1__Norovirus_and/or_Norovirus-like__GQ856447
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccaaccucucucaccuggcucgcauguacaauggguaugccggaggcuucgaaguccaggugauccuugcuggcaacgccuuuacagcggggaaaauuaucuucgccgcuguuccucccaauuuuccuacggagggacugagccccucccaggugaccauguucccgcauaucauugucgacgugagacaacucgagccugugcugaucccccugccugauguccggaacaauuuuuaccacuauaaccagucuaacgacagcacaauuaagcucaucgccaugcuguacacaccccuucgcgcuaauaacgccggcgaagauguuuucaccguguccugcagagugcugacccggcccagcccugacuuugauuucauuuuucucgucccgcccacaguggagucucgcaccaaaccuuucacgguucccauccugaccguggaagagaugacaaauuccagauuuccuauuccccuugagaagcuguucaccgggccgagcucugccuucgucgugcagccucagaacggacgguguacaaccgacggcguucuccuggggacgacacaacugucccccgugaauaucugcaccuuucgcggagaugucacacauaucgcuggcagcagaaacuauaccaugaaucucgcgucucugaacuggaauaacuacgacccuaccgaagagauucccgccccucuuggcacacccgauuucguggggaaaauccagggaguccugacgcagaccacaaagggcgacggguccacccggggacacaaggcuacaguguauaccggcagcgccccguuuacgccuaaacucggguccguucaguucucuacagacaccgaaaaugauuuugagacccaucaaaacacaaaguucacccccgugggagucauucaggacggcggcacaacgcaccgcaaugaaccccagcaaugggugcugccuagcuacuccgggagaaacguucagaaugugcaccuugccccggcugucgcccccaccuuuccuggagagcagcuccuguucuuucggagcacaaugcccggcuguucuggguacccuaacauggaucuggacugccugcucccccaggagugggugcaacauuucuaucaggaagcggcuccugcccaguccgauguggcccugcuucgcuuuguuaaccccgacaccggaagaguccuguucgaguguaaacuccacaagagcggcuacgugacaguggcucauaccgggcagcacgaucuggucaucccgccuaauggcuauuuucgguucgacucuugggugaaccaauucuacacgcuugcccccaugggaaauggcaccgggagacgccgguga

SEQ ID NO: 29395 - RNA, 1617 nt, Artificial Sequence
  derived and/or modified sequence opt5 from VP1__Norovirus_and/or_Norovirus-like__AB541318
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggaaauacagcccaucggaacgagccccaacagugggugcucccuucuuacagcggccgcaauucccacaacguucaccuggcgccggcuguggcccccacguuuccuggcgaacagcuucuguucuuuagaagcaccaugcccggguguucuggauauccuaauauggaucucgacugccugcugccccaggaguggguccaauacuucuaucaggaagccgcuccugcccaguccgauguggcucuccugcgguuugugaaccccgacacaggcagaguucuuuucgaguguaagcugcauaaaagcggguacgucaccguggcccacacaggacagcaugaucucgugaucccgccuaacggcuauuuucgcuucgacucuugggucaaucaauucuacacccuggcgcccauggggaacggcacgggacggagacgcuga

SEQ ID NO: 29396 - RNA, 1617 nt, Artificial Sequence
  derived and/or modified sequence opt5 from VP1__Norovirus_and/or_Norovirus-like__AB541307
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagccuggcuaugugacaguggcucauaccgggcagcacgaucuggucauccccagcaacggcuacuuucgguucgacucuugggugaaucaguucuauacgcuugccccuaugggaaacggcaccgggagacgccgguga

SEQ ID NO: 29397 - RNA, 1617 nt, Artificial Sequence
  derived and/or modified sequence opt5 from VP1__Norovirus_and/or_Norovirus-like__AB541254
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguuaaagcccccggcggggaauuuaccgugagcccucggaacucccccggagagauucuguggucugcgccucuuggcccggaucugaaucccuaccucagccaccuggcccgcauguauaacggguacgcuggaggcuucgaaguccaggugauccuugccggcaaugcuuuuacagccgggaagauuaucuucgcggccguuccucccaacuuuccuacggagggacugucccccucucaggugaccauguucccgcauaucauugucgacgugagacagcucgagccugugcugaucccccugccugauguccggaauaacuuuuaucacuacaaucaaagcaacgacuccacaauuaaacucaucgcuaugcuguauacaccccuucgcgccaacaaugcuggcgaugacguuuucaccgugagcugcagagugcugacccggcccucuccugauuuugacuucauuuuucucgucccgcccacaguggaaucccgcaccaagccuuucacgguucccauccugaccguggaggaaaugacaaacagcagauuuccuauuccccuugagaaacuguucaccgggccgucuuccgccuucaucguccagccucagaauggacgguguacaaccgauggcgugcuccuggggacgacacagcugagccccguuaacaucugcaccuuucgcggagacgugacacauauugccggcucuagaaauuacaccaugaaccucgcuucccugaauuggaacaauuaugauccuaccgaggaaguccccgcgccucuuggcacacccgacuucguggggaagauccaaggaguccugacgcagaccacaaagggcgacgggagcacccggggacacaaagccacaguguacaccggcuccgcugauuuuacgccgaagcucgggucuguucaguucggaacagacaccgagaacgauuuugaaacccaucagaauacaaaauucaccccugugggcgucauucaagacggcagcacaacgcaccgcaacgagccccagcagugggugcugcccuccuacagcgggagaaauguucacaacgugcaucuugccccugccgucgcuccgaauuuucccggagaacaacuccuguucuuucggucuaccaugccuggcuguuccggguaucccaacauggaucuggacugccugcucccucaggagugggugcagcacuucuaccaggaggccgcgcccgcucaaagcgauguggcccugcuucgcuuuguuaacccugacacaggaagaguccuguucgaauguaagcuccauaaaucuggcuaugugaccguggcccacacagggcagcacgaucuggucauucccccgaauggcuacuuucgguucgacagcugggugaaccaguucuauacccuugcuccuaugggaaauggcacggggagacgccgguga

SEQ ID NO: 29398 - RNA, 1617 nt, Artificial Sequence
  derived and/or modified sequence opt5 from VP1__Norovirus_and/or_Norovirus-like__AB541243
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauuccuugguccgccccgcugggccccgaucuuaauccuuaccugucucaccucgcucgcauguauaacggguacgccggaggcuucgaaguccaggugauccuggcuggcaaugccuuuacagcggggaaaauuaucuucgccgcuguucccccuaacuuucccacggagggacuuagcccgucccaggugaccauguucccucauaucauugucgacgugagacaacuggagcccgugcucaucccucugcccgauguccggaauaacuuuuaucacuacaaucagucuaacgacagcacaauuaagcugaucgccaugcucuauacaccccugcgcgcuaacaaugccggcgaagauguuuucaccguguccugcagagugcuuacccggccuagcccggacuuugauuucauuuuucuggugcccccuacagucgagucucgcaccaaacccuucacgguuccuauccucaccguggaagagaugacaaacuccagauuucccauuccgcuggagaaacuuuucaccgggccuagcucugccuucgucgugcagccccagaauggacgguguacaaccgacggcguucugcucgggacgacacaacuguccccugugaacaucugcaccuuucgcggagaugucacacauaucgcuggcagcagagacuacaccaugaaucuggcgucucucaacuggaauaacuaugaucccaccgaagagauuccugcuccccugggcacaccggacuucguggggaagauccagggaguccuuacgcagaccacaaagggcgacggguccacccggggacacaaggccacaguguacaccggcagcgccccuuuuacgcccaaacugggguccguucgcuucucuacagauaccgaaaaugacuuugagacccaucagaacacaaaguucacccccgugggagucauucaagauggcagcacaacgcacagaaaugaaccucagcagugggugcucccguccuacagcggccgggacguucacaacgugcaucuggcccccgcugucgccccuaccuuucccggggagcaacuucuguucuuucgcucuacaaugccuggauguuccggcuaucccaauauggaucucgacugccugcugccucaggagugggugcagcacuucuaccaggaagcggcucccgcccaaagcgauguggcccuccugagauuuguuaacccggacaccgggcggguccuuuucgaguguaaacugcauaagucuggauaugugacaguggcucacaccggccagcacgaucucgucaucccucccaauggguacuuuagauucgacagcugggugaaccaguucuauacgcuggccccuaugggcaacggaaccggccgccggagauga

SEQ ID NO: 29399 - RNA, 1617 nt, Artificial Sequence
  derived and/or modified sequence opt5 from VP1__Norovirus_and/or_Norovirus-like__AB541232
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagagacuacaccaugaaucucgcgagccugaacuggaauaacuaugauccuaccgaagagauucccgccccucuugggacacccgacuucgugggaaaaauccagggcguccugacgcagaccacaaagggggacggaucuacccggggccacaaggcuacaguguacaccggguccacgccguuuacaccuaaacucggaagcguucaguucuccaccgauaccgaaaaugacuuugagacacaucaaaacaccaaguucacacccgugggcgucauucaggauggcucuacgacccaccgcaaugaaccccagcaaugggugcugccuagcuacuccgggagaaacguucagaaugugcaccuugccccggccgucgcucccacauuuccuggagagcagcuccuguucuuucggagcaccaugcccggcuguucuggguauccuaacauggaccuggauugccugcucccccaggagugggugcaacauuucuaccaggaagccgcgccugcucaguccgacguggcccugcuucgcuuuguuaaucccgauacaggaagaguccuguucgaguguaaacuccacaagagcggcuaugugaccguggcccauacggggcagcacgaccuggucaucccgccuaacggcuacuuucgguucgauucuugggugaaccaauucuauacccuugcucccaugggaaauggcacagggagacgccgguga

SEQ ID NO: 29400 - RNA, 1617 nt, Artificial Sequence
  derived and/or modified sequence opt5 from VP1__Norovirus_and/or_Norovirus-like__GQ246800
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucccgucccucccaccguggaaagccgcacgaaaccuuucaccguucccauccucacaguggaggaaaugaccaacucuagauuuccgauuccucuggagcggcuuuacacagggcccuccagcgccuucgucgugcagccucagaauggacgcuguaccacggauggcguucugcucgggacaacccaacugucugccgugaacaucugcacauucagaggagacgucacccauaucgcuggcucccggaauuauaccaugaaccuggcgagccagaauuggaacaauuacgaucccacagaggaaauuccugcuccccucggcacgccggacuuuguggggaagauccagggaaugcugacccagacaacccgcucugacggcuccacaagagggcacaaagccaccguccuuacgggaagcgccgauuucgccccuaagcugggccgggugcaauuugcuacagacaccgauaacgacuucgaguccgggcagaauaccaaguuuacacccguuggagugauucaggauggcucuaccacacaucgcaacgaaccccaacaguggguccucccuaauuacagcggcagaacggggcacaacgugcaccuggccccggcgguugcucccaccuauccuggagagcagcuucuguucuuucgguccacaaugcccggcuguagcggguacccuaauauggaccucgauugccugcugccccaggaaugggugcaacauuucuaucaggaggccgccccugcucagucugacgucgcccuccugagauuugugaaccccgauaccggacgcgugcuuuucgaguguaaacugcacaaguccggcuacguuacagucgcucauaccgggcagcacgaccucgugaucccgccuaacggcuauuuucgguucgauagcugggugaaucaauuuuacacgcuggcccccaugggaaacggcaccgggagacgccgguga

SEQ ID NO: 29401 - RNA, 1617 nt, Artificial Sequence
  derived and/or modified sequence opt5 from VP1__Norovirus_and/or_Norovirus-like__GU390900
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuagcgacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguucagaaugugcaccuugccccggcugucgcccccaccuuuccuggagagcagcuccuguucuuucggucuacaaugcccggcuguuccggguauccuaacauggaucuggacugccugcucccccaggagugggugcaacauuucuaccaggaagcggcuccugcccagagcgauguggcccugcuucgcuuuguuaaucccgacaccggaagaguccuguucgaguguaaacuccacaagucuggcuaugugacaguggcucauaccgggcagcacgaucuggucaucccgccuaacggcuacuuucgguucgacagcugggugaaccaauucuauacgcuugcccccaugggaaauggcaccgggagacgccgguga

SEQ ID NO: 29402 - RNA, 1617 nt, Artificial Sequence
  derived and/or modified sequence opt5 from VP1__Norovirus_and/or_Norovirus-like__AB504328
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucaccagccugaauuggaacaauuaugacccuacagaagagauucccgcgccucuugggacgcccgauuucgugggaaaaauccagggccugcucacccagacaaccaagggggacggaucuacacggggccacaaggccaccgucuacacgggguccgcuccguuuacaccuaaacugggaagcgugcaguucuccaccgacaccgaaaacgauuuugagacacaucaaaauaccaaguucacacccguuggcgugauucaggacggcucuacgacccaccgcaacgaaccccagcaauggguccuuccuagcuacuccgggaucaaugugcacaacguucaucuggccccggccguggcucccacauuuccuggagagcagcuccuguucuuuagaagcaccaugcccggcuguucuggguauccuaauauggaucuggacugccuccugccccaggaguggguccagcacuucuaccaagaagccgcgccugcucaguccgauguggcccuucugcgguuugugaaccccgacacaggacgcguucucuucgaguguaaacugcauaagagcggcuaugucaccguggcccacacggggcagcacgaucuugugauuccgccuaacggcuacuuuagauucgacucuugggucaaucaguucuauacccuggcucccaugggaaacggcacagggcggagacgcuga

SEQ ID NO: 29403 - RNA, 1617 nt, Artificial Sequence
  derived and/or modified sequence opt5 from VP1__Norovirus_and/or_Norovirus-like__AB447434
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacagcuacgccgggggauucgaaguccaggugauccuugcuggcaaugccuuuacagcgggcaaaauuaucuucgccgcuguuccucccaacuuuccuacggaggggcugucccccucucaggugaccauguucccgcauaucauugucgacgugagacaacucgagccugugcugaucccccugccugauguccggaauaacuuuuaucacuacaaucagagcaacgaccccacaauuaagcucaucgccaugcuguauacaccccuucgcgcuaacaaugccggagaagauguuuucaccguguccugcagagugcugacccggccuagcccggacuuugauuucauuuuucucgugcccccuacagucgagucucgcaccaaacccuucacgguuccuauccugaccguggaagagaugacaaacuccagauuucccauuccgcuugagaagcuguucaccggcccuagcggggccuucgucgugcagccccagaauggacgguguacaaccgacggcguucuccuggggacgacacaacugucuccugugaacaucugcaccuuucgcggagaugucacacauaucgcuggcuccagaaauuacaccaugaaccucgcgagccugaauuggaacaauuaugaccccaccgaagagauuccugcuccccuuggcacaccggauuucguggggaaaauccagggaguccugacgcagaccacaaagggcgacgggucuacccggggacacaaggccacaguguacaccggcuccgccccuuuuacgcccaaacucgggagcguucaguucuccacagacaccgaaaacgauuuugagacccaucaaaauacaaaguucacccccgugggagucauucaggacggcucuacaacgcaccgcaacgaaccucagcaaugggugcugccgagcuacuccggcagaaauguucacaacgugcaucuugcccccgcugucgccccuaccuuucccggggagcagcuccuguucuuucggagcacaaugccuggauguucuggcuaucccaauauggaucuggacugccugcucccucaggagugggugcagcacuucuaccaagaagcggcucccgcccaguccgauguggcccugcuucgcuuuguuaacccggacaccgggagaguccuguucgaguguaaacuccauaagagcggauaugugacaguggcucacaccggccagcacgaucuggucaucccucccaacggguacuuucgguucgacucuugggugaaucaguucuauacgcuugccccuaugggcaacggaaccggcagacgccgguga

SEQ ID NO: 29404 - RNA, 1617 nt, Artificial Sequence
  derived and/or modified sequence opt5 from VP1__Norovirus_and/or_Norovirus-like__EU839591
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccggggaguccugacgcagaccacaaagggcgacggguccacccgcggacacaaggcuacaguguacaccggcagcgccccguuuacgccuaaacucggguccguucaguucucuacagacaccgaaaacgauuuugagacccaucagaauacaaaguucacccccgugggagucauucaagacggcggcacaacgcacagaaacgaaccccagcagugggugcugccuagcuacuccgggcggaauguuccgaacgugcaccuugcccccgcugucgccccuaccuuucccggagagcaacuccuguucuuucgcagcacaaugccuggcuguucuggguaucccaauauggaucuggacugccugcucccucaggagugggugcagcauuucuaccaggaagcggcucccgcccaauccgauguggcccugcuuagauuuguuaacccggacaccggacggguccuguucgaguguaaacuccacaagagcggcuaugugacaguggcucauaccgggcagcacgaucuggucaucccucccaacggcuacuuuagauucgacucuugggugaaucaguucuauacgcuugccccuaugggaaacggcaccgggcgccggagauga

SEQ ID NO: 29405 - RNA, 1617 nt, Artificial Sequence
  derived and/or modified sequence opt5 from VP1__Norovirus_and/or_Norovirus-like__AB291542
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacgggcaugccggaggcuucgaaguccaggugauccuugcuggcaaugccuuuacggcggggaaaauuaucuucgccgcuguuccucccaacuuuccuaccgagggacugagccccucccaggugacaauguucccgcacaucauugucgacgugagacagcucgagccugugcugaucccccugccugauguccggaauaacuuuuaccauuauaaucaaucuaacgacagcaccauuaagcucaucgccaugcuguacacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccacaucgcuggcuccagaaauuauaccaugaaccucgcgagccugaauuggaacaauuacgacccuacagaagagauucccgccccucuugggacgcccgauuucgugggaaaaauccaaggcguccugacccagacaaccaagggggacggaucuacacggggccauaaggcuaccguguauacgggguccgccccguuuacaccuaaacucggaagcguucaguucuccaccgacaccgaaaacgauuuugagacacaccagaauaccaaguucacacccgugggcgucauucaagacggcucuacgacccaccgcaacgaaccccagcagugggugcugccuagcuacuccgggagaaauguucauaacgugcaccuugccccggcugucgcccccacauuuccuggagagcaacuccuguucuuucggagcaccaugcccggcuguucuggguacccuaauauggaucuggacugccugcucccccaggagugggugcagcauuucuaucaggaagcggcuccugcccaauccgauguggcccugcuucgcuuuguuaaccccgacacaggaagaguccuguucgaguguaaacuccacaagagcggcuacgugaccguggcucacacggggcagcaugaucuggucaucccgccuaacggcuauuuucgguucgacucuugggugaaucaguucuacacccuugcccccaugggaaacggcacagggagacgccgguga

SEQ ID NO: 29406 - RNA, 1617 nt, Artificial Sequence
  derived and/or modified sequence opt5 from VP1__Norovirus_and/or_Norovirus-like__KX354123
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagcggcuguucacagggccuucuuccgccuucgugguccagccccagaacggacgcuguaccacagauggcgugcuccuggggaccacgcaacugagcccugucaauauuugcacauuuagaggagacgugacccauaucacaggcucucacaacuacaccaugaaucucgcuucccagaacuggaauaacuaugaucccaccgaggaaauuccugcgccccugggcacaccggacuucguugggaagauccagggagugcuuacgcagaccacacggaccgacggcagcacacgcgggcauaaagccacccuguacacgggauccgcugaguuugccccuaagcucggcagaguccaauucgaaacagauaccaaucacgacuuugaggccaaccagaauaccaaguucacacccguggggguuauccaggauggaucuaccacacaccggaacgaaccccaacagugggugcugccuacguacagcggccgcaauacccauaacguccaccuugcuccggccguggcgcccacauuuccuggcgagcagcuccuguucuuuagauccaccaugcccggguguagcggauauccuaauauggaccuggauugccugcucccccaggagugggugcaacauuucuaccaggaagcugccccugcccagucugacguugcucugcuucgguuugucaaccccgauacaggcagagugcuguucgaguguaaacuccacaaguccggguauauuaccguggcccacacgggacagcaugaccuggucaucccgccuaacggcuacuuucgcuucgauagcugggugaaucaauucuauacccuugcucccauggggaacggcacaggacggagacgcuga

SEQ ID NO: 29407 - RNA, 1617 nt, Artificial Sequence
  derived and/or modified sequence opt5 from VP1__Norovirus_and/or_Norovirus-like__KX354050
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggccuugaaguccaggugauccuggcuggcaacgccuucacagcggggaaaauuaucuuugccgcuguuccucccaauuucccuacggagggacucucccccucucaggugaccauguuuccgcauaucauugucgacgugagacaacuggagccugugcugaucccccucccugauguccggaacaauuucuaucacuacaaccagagcaaugaccccacaauuaagcugaucgccaugcuuuauacaccccugcgcgcuaacaacgccggcgaugacguuuuuaccguguccugcagagugcucacccggccuagcccggauuucgacuuuauuuuccuggugcccccuacagucgaaucucgcaccaaacccuuuuccguuccuauccuuacgguggaggaaaugaccaauagcagauuccccauuccgcuggagaagcucuuuacagggccuucuuccgccuucgucgugcagccccagaacggacgguguaccacagauggcguucugcuggggaccacgcaacucagcccugugaauaucugcacauuccgcggagacgucacccauaucacaggcucuagaaacuacaccaugaaucuggcuucccagaacuggaauaacuaugaucccaccgaggaaauuccugcgccccuuggcacaccggacuuuguggggaaaauccagggaguccugacgcagaccacacgggccgacggcagcacccgcgggcacaaggcuacaguguacaccggauccgccgauuucgccccuaagcucggcagaguucaauuugagacggacacagaucaugacuucgaagcuaaucagaacaccaaauuuacccccgugggggucauucaggauggaggcacaacccaccggaaugagccccaacagugggugcugccuucuuacagcggccgcaacacacacaauguucaucuugccccggcgguggcucccacguucccuggggaacagcugcucuuuuucagauccaccaugcccggauguagcggcuauccuaacauggaccuggauugccugcucccccaggaguggguccaauacuuuuaucaggaggccgccccugcucagucugacguggcccugcuucgguucgugaaucccgauacagggagaguucuguuugaauguaagcuccacaaauccggauacgucaccguggcucauacaggccagcacgaccuggugaucccgccuaacggguauuuccgcuuugauagcugggucaaccaauucuacacccuugcccccaugggcaauggaacgggccggagacgcuga

SEQ ID NO: 29408 - RNA, 1617 nt, Artificial Sequence
  derived and/or modified sequence opt5 from VP1__Norovirus_and/or_Norovirus-like__AB933717
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagagauguuccgaaugugcaccuugcccccgcugucgccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguggcccugcuucgcuuuguuaauccggauaccggaagaguccuguucgaguguaaacuccacaagagcggcuaugugacaguggcucauaccgggcagcacgaccuggucaucccucccaacggcuacuuucgguucgauucuugggugaaccaguucuauacgcuugccccuaugggaaauggcaccgggagacgccgguga

SEQ ID NO: 29409 - RNA, 1617 nt, Artificial Sequence
  derived and/or modified sequence opt5 from VP1__Norovirus_and/or_Norovirus-like__AB933707
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagagacuacaccaugaaccucgcgucccugaauuggaacaauuaugauccuaccgaagagauucccgccccucuuggcacacccgacuucguggggaaaauccagggaaugcugacgcagaccacaaagggcgacgggagcacccggggacacaaggcuacagucuacaccggcuccgccccguuuacgccuaaacucgggucugugcaguucagcacagauaccgaaaacgacuuugagacccaucaaaauacaaaguucacccccguuggagugauucaggauggcuccacaacgcaccgcaacgaaccccagcaauggguccugccuagcuacucuggcagaaaugugccgaacguucaccuugcccccgcuguggccccuaccuuucccggggagcagcuccuguucuuucgguccacaaugccuggauguagcggcuaucccaauauggaccuggauugccugcucccucaggaguggguccagcauuucuaccaagaagcggcucccgcccagucugacguggcccugcuucgcuuugugaacccggauaccgggagaguucuguucgaguguaaacuccacaagagcggauaugucacaguggcucauaccggccagcacgaccuggugaucccucccaauggguacuuucgguucgauuccugggucaaccaguucuauacgcuugccccuaugggcaacggaaccggcagacgccgguga

SEQ ID NO: 29410 - RNA, 1617 nt, Artificial Sequence
  derived and/or modified sequence opt5 from VP1__Norovirus_and/or_Norovirus-like__AB933705
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagacacugugguccgccccucuuggcccggaucugaaucccuaccucucucaccuggcucgcauguauaacggguacgccggaggcuucgaaguccaggugauucuugcuggcaaugccuuuacggcggggaaaaucauuuucgccgcuguuccucccaacuuuccuaccgagggacugagccccucccaggugacaauguucccgcauaucaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaagauguuuucaccguguccugcagagugcugacacggcccagcccugacuuugauuucaucuuucucgucccgcccaccguggagucucgcacgaaaccuuucaccguucccauucugacaguggaagagaugaccaacuccagauuuccuaucccccuugagaagcuguucacagggccgagcucugccuucgucgugcagccucagaauggacgguguaccacggacggcguucuccuggggacaacccaacugucccccgugaacauuugcacauuucgcggagaugucacccauaucgcuggcagcagaaauuacaccaugaaccucgcgucucugaauuggaacaauuaugacccuacagaagagauccccgccccucuuggcacgcccgauuucguggggaaaauucagggaaugcugacccagacaaccaagggcgacggguccacacggggacacaaggcuaccgucuacacgggcagcgccccguuuacaccuaaacucggguccgugcaguucucuaccgacaccgaaaacgauuuugagacacaucaaaauaccaaguucacacccguuggagugauccaggacggcagcacgacccaccgcaacgaaccccagcaauggguccugccuuccuacagcggcagaaaugugccgaacguucaccuugcccccgcuguggccccuacauuucccggggagcagcuccuguucuuucggucuaccaugccuggauguuccggcuaucccaauauggaucuggacugccugcucccucaggaguggguccagcauuucuaccaagaagcggcucccgcccagagcgauguggcccugcuucgcuuugugaacccggacacagggagaguucuguucgaguguaaacuccacaagucuggauaugucaccguggcucauacgggccagcacgaucuggugauuccucccaacggguacuuucgguucgacagcugggucaaucaguucuauacccuugccccuaugggcaacggaacaggcagacgccgguga

SEQ ID NO: 29411 - RNA, 1617 nt, Artificial Sequence
  derived and/or modified sequence opt5 from VP1__Norovirus_and/or_Norovirus-like__AB933704
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagagcggcuaugugacaguggcucauaccgggcaguacgaucuggucaucccucccaacggcuauuuucgguucgacucuugggugaaucaguucuacacgcuugccccuaugggaaacggcaccgggagacgccgguga

SEQ ID NO: 29412 - RNA, 1617 nt, Artificial Sequence
  derived and/or modified sequence opt5 from VP1__Norovirus_and/or_Norovirus-like__AB933699
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagcucaacgacucuaccaucaagcugauugccaugcuuuauacaccccugcgcgcuaacaaugccggcgaagauguuuucaccgugagcugcagagugcucacacggcccuccccugacuuugauuucaucuuucuggucccgcccaccguggagagccgcacaaaaccuuucaccguucccauucuuacgguggaagagaugaccaacucuagauuuccuaucccccuggagaaacucuucacagggccguccagcgccuucgucgugcagccucagaauggacgguguaccacagacggcguucugcuggggaccacgcaacucucucccgugaacaucugcacauuucgcggagaugucacccauauugcuggcuccagaaauuacacaaugagccuggcgucucuuaacuggaauaacuaugacccuaccgaagagauccccgccccucugggcacccccgauuucguggggaagauucagggaguccucacacagacgaccaagggcgacggguccacacggggacacaaggcuaccguguacacaggcagcgccccguuuaccccuaaacugggguccguucaguucucuacggacacagaaaaugauuuugagacccaucaaaacaccaaguucacacccgugggagucauccaggacggcggcaccacacaccgcaaugaaccccagcaaugggugcuuccuagcuacuccgggagaaacguuccgaaugugcaccuggcccccgcugucgccccuacguuucccggagagcagcuccuguucuuucggagcaccaugccuggcuguucuggguaucccaacauggaucuggacugccuccugccucaggagugggugcagcauuucuaccaagaagcggcucccgcccaguccgauguggcccuucugcgcuuuguuaauccggacacaggaagaguccucuucgaguguaaacugcacaagagcggcuaugugaccguggcucauacagggcagcacgaucuugucauuccucccaacggcuacuuucgguucgacucuugggugaaccaguucuauacccuggccccuaugggaaauggcacggggagacgccgguga

SEQ ID NO: 29413 - RNA, 1617 nt, Artificial Sequence
  derived and/or modified sequence opt5 from VP1__Norovirus_and/or_Norovirus-like__AB933679
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucaucguccagccucagaauggacgguguacaaccgacggcgugcuccuggggacgacacaacugucccccguuaacaucugcaccuuucgcggagaugugacacauauugcuggcagcagaaauuacaccaugaaccucgcgucucugaauuggaacaauuaugacccuaccgaagagauccccgccccucuuggcacacccgauuucgucgggaaaauucagggagugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauccaggacggcggcacaacgcaccgcaacgaaccccagcaauggguccugccuagcuacuccgggagaaaugugccgaacguucaccuugcccccgcuguggccccuaccuuucccggagagcagcuccuguucuuucggagcacaaugccuggcuguucuggguaucccaauauggaucuggacugccugcucccucaggaguggguccagcauuucuaccaagaagcggcucccgcccaguccgauguggcccugcuucgcuuugugaacccggacaccggaagaguucuguucgaguguaaacuccacaagagcggcuaugucacaguggcucauaccgggcagcacgaucuggugauuccucccaacggcuacuuucgguucgacucuugggucaaucaguucuauacgcuugccccuaugggaaacggcaccgggagacgccgguga

SEQ ID NO: 29414 - RNA, 1617 nt, Artificial Sequence
  derived and/or modified sequence opt5 from VP1__Norovirus_and/or_Norovirus-like__AB933661
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgaaccucuuggcccggaucugaaucccuaccucucucaccuggcccgcauguauaacggguacgcuggaggcuucgagguccaggugauccuugccggcaaugcuuuuacagccgggaaaauuaucuucgcggccguuccucccaacuuuccuacggagggacugagccccucccaggugaccauguucccgcauaucauugucgacgugagacaacucgaaccugugcugaucccccugccugauguccggaauaacuuuuaucacuacaaucagucuaacgacagcacaauuaagcucaucgcuaugcuguauacaccccuucgcgccaacaaugcuggcgaggauguuuucaccguguccugcagagugcugacccggcccagcccugacuuugauuucauuuuucucgucccgcccacaguggaaucucgcaccaaaccuuucacgguucccauccugaccguggaggagaugacaaacuccagauuuccuauuccccuugaaaagcuguucaccgggccgagcucugccuucgucgugcagccucagaauggacgguguacaaccgacggcguucuccuggggacgacacaacugucccccgugaacaucugcaccuuucgcggagaugucacacauaucgccggcagcagaaauuacaccaugaaccucgcuucucugaauuggaacaauuaugacccuaccgaggaaauucccgcgccucuuggcacacccgauuucguggggaaaauccagggaguccugacgcagaccacaaagggcgacggguccacccggggacacaaggccacaguguacaccggcagcgcuccguuuacgccuaaacucggguccguucaguucucuacagacaccgagaacgauuuugaaacccaucaaaauacaaaguucacccccgugggagucauucaggacggcggcacaacgcaccgcaacgagccccagcaaugggugcugccuagcuacuccgggagaaauguuccgaacgugcaccuugcccccgccgucgcuccuaccuuucccggagagcagcuccuguucuuucggagcacaaugccuggcuguucuggguaucccaauauggaucuggacugccugcucccucaggaaugggugcagcauuucuaccaagaggccgcgcccgcucaguccgauguggcccugcuucgcuuuguuaacccggacaccggaagaguccuguucgaauguaaacuccacaagagcggcuaugugacaguggcccauaccgggcagcacgaucuggucaucccucccaacggcuacuuucgguucgacucuugggugaaucaguucuauacgcuugcuccuaugggaaacggcaccgggagacgccgguga

SEQ ID NO: 29415 - RNA, 1617 nt, Artificial Sequence
  derived and/or modified sequence opt5 from VP1__Norovirus_and/or_Norovirus-like__KT152148
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuaugugacaguggcucacaccgggcagcacgaucuggucaucccgccuaacggcuacuuucgguucgacucuugggugaaucaguucuauacgcuugcccccaugggaaacggcaccgggagacgccgguga

SEQ ID NO: 29416 - RNA, 1617 nt, Artificial Sequence
  derived and/or modified sequence opt5 from VP1__Norovirus_and/or_Norovirus-like__EU921393
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagccacaacuacaccaugaaucucgcgucucugaacuggaauaacuaugacccuaccgaagagauucccgccccucuugggacacccgauuucgugggaaaaauccagggcguccugacgcagaccacaaagggggacggauccaccagaggccauaaggcuacaguguacaccgggagcgccccguuuacgccuaaacucggauccguucaguucucuacagacaccgaaaaugauuuugagacccaccaaaacacaaaguucacccccgugggcgucauucaggacggcagcacaacgcaccggaaugaaccccagcaaugggugcugccuuccuacagcgggucuaacguucauaaugugcaccuugccccggcugucgcccccaccuuuccuggagagcagcuccuguucuuucgcuccacaaugcccggcuguagcggguauccuaacauggaucuggacugccugcucccccaggagugggugcagcauuucuaccaagaagcggcuccugcccagucugauguggcccugcuuagauuuguuaaucccgacaccggacggguccuguucgaguguaaacuccacaagagcggcuaugugacaguggcucacaccgggcagcaugaucuggucaucccgccuaacggcuacuuucgcuucgacuccugggugaaccaguucuauacgcuugcccccaugggaaauggcaccgggagacggagauga

SEQ ID NO: 29417 - RNA, 1617 nt, Artificial Sequence
  derived and/or modified sequence opt5 from VP1__Norovirus_and/or_Norovirus-like__KM396961
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauacaaccggcucucacaacuacaccaugaaucucgcuucccagaacuggagcaauuaugaucccacagaggaaaucccugcgccccugggcacgccggacuucguugggaaaauucagggagugcuuacccagacaaccagaacagacggcuccacccgggggcauaaggccacgguccgcacaggaucugcugauuuugccccuaagcugggcagagugcaauucgagaccgacaccgaucacgacuuugaagccaaccagaauacaaaauucacccccguuggggugauccaggauggaagcacaacgcaccggaacgagccccaacaguggguccucccuuccuacagcggccgcaauaccccgaacgugcaucuggcucccgccguggcgccuacauuucccggcgaacagcuucuguucuuuagaucuaccaugccuggguguuccggauaccccaauauggaccucgauugccugcugccucaggaguggguucaacacuucuaucaggaggcugcccccgcccagagcgacgucgcucuccugcgguuugugaacccggauacaggcagagugcuuuucgaauguaagcugcauaaaucuggguacgucaccguggcccacacgggacagcacgaccucguuaucccucccaauggcuauuuucgcuucgauagcugggugaaccaauucuacacccuggcuccuauggggaacggcacaggacggagacgcuga

SEQ ID NO: 29418 - RNA, 1617 nt, Artificial Sequence
  derived and/or modified sequence opt5 from VP1__Norovirus_and/or_Norovirus-like__KM198485
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagacaaacgacucuaccauuaagcucaucgccaugcuguauacaccccuucgcgcuaacaaugccggcgaagauguuuucaccgugagcugcagagugcugacacggcccuccccugacuuugauuucauuuuucucgucccgcccaccguggagagccgcacgaaaccuuucaccguucccauccugacaguggaagagaugaccaacucuagauuuccuauuccccuugagaagcuguucacagggccguccagcgccuucgucgugcagccucagaauggacgguguaccacggacggcguucuccuggggacaacccaacugucucccgugaacaucugcacauuucgcggagaugucacccauaucgcuggcuccagaaauuacaccaugaaccucgcgagccugaauuggaacaauuaugacccuacagaagagauucccgccccucuuggcacgcccgauuucguggggaaaauccagggaguccugacccagacaaccaagggcgacgggucuacacggggacacaaggcuaccguguacacgggcuccgccccguuuacaccuaaacucgggagcguucaguucuccaccgacaccgaaaacgauuuugagacacaucaaaauaccaaguucacacccgugggagucauucaggacggcggcacgacccaccgcaacgaaccccagcaaugggugcugccuucuuacagcgggagaaauguucacaacgugcaucuugccccggcugucgcccccacauuuccuggagagcagcuccuguucuuucgguccaccaugcccggcuguagcggguauccuaauauggaucuggacugccugcucccccaggagugggugcagcacuucuaccaagaagcggcuccugcccagucugauguggcccugcuucgcuuuguuaaccccgacacaggaagaguccuguucgaguguaaacuccauaaguccggcuaugugaccguggcucacacggggcagcacgaucuggucaucccgccuaacggcuacuuucgguucgacagcugggugaaucaguucuauacccuugcccccaugggaaacggcacagggagacgccgguga

SEQ ID NO: 29419 - RNA, 1617 nt, Artificial Sequence
  derived and/or modified sequence opt5 from VP1__Norovirus_and/or_Norovirus-like__KF306214
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcgccccggacuucguugggaaaauccagggagugcuuacacagacgacccggacagacggcagcacccgcgggcacaaggcuacagucuacaccggauccgccgauuuugccccuaagcugggcagagugcaauucgagacggacacagaucaugacuuugaaguuaaucagaacaccaaauucacccccgugggggucauccaggauggaggcacaacccaccggaaugagccccaacagugggugcucccuucuuacagcggccgcaacacaccgaaugugcaccuggcucccgccguugcgccuacguuucccggggaacagcuucuguucuuuagauccaccaugccuggauguagcggcuaucccaacauggaccucgauugccugcugccucaggaguggguccaauacuucuaucaggaggcugcccccgcccagucugacguggcucuccugcgguuugugaauccggauacagggagaguccuuuucgaauguaagcugcauaaauccggauacgugaccguugcccacaacggccagcaugaccucgugauuccucccaacggguauuuucgcuucgauagcugggucaaucaauucuacacacuggcuccuaugggcaacggaaccggccggagacgcuga

SEQ ID NO: 29420 - RNA, 1617 nt, Artificial Sequence
  derived and/or modified sequence opt5 from VP1__Norovirus_and/or_Norovirus-like__JX439831
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaucgauggcguucuccuggggaccacgcaacugagcccugugaauaucugcacauuucgcggagacgucacccauauuacaggcucuagaaacuacaccaugaaucucgccacccagaacuggaacuccuaugaucccacagaggaaaucccugcuccccugggcacgccggacuucguggggaaaauucagggaguccuuacccagacaacccgggcggacggcagcacacgcgggcacaaggccaccguguacacgggauccgcugauuuugccccuaagcugggcagaguucaauucgccacagacaccgauaaugacuuugaugcuaaucagaacaccaaauucacacccgugggggucauccaggacggaaauaccgcccaucggaacgagccccaacagugggugcucccuucuuacagcggccgcaauucccacaacguucaccuggcgccggcuguggcccccacauuuccuggcgaacaguuccuguuuuucagaagcacgaugcccggguguucuggauauccuaauauggaucuugacugccuccugccccaggaguggguccaauacuuuuaucaggaagccgcuccugcccaguccgauguggcucugcuccgguucgugaaccccgacaccggcagaguucuguuugaguguaaacuucauaagagcggguacgucacaguggcccacaccggacagcaugaucuggugauuccgccuaacggcuauuuccgcuucgacucuugggucaaucaauuuuacacacucgcgcccauggggaacggcaccggacggagacgcuga

SEQ ID NO: 29421 - RNA, 1617 nt, Artificial Sequence
  derived and/or modified sequence opt5 from VP1__Norovirus_and/or_Norovirus-like__KC409281
augaagauggccagcaacgacgcuaaucccuccgauggcucugccgcgagccuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucagacaaacgaccccaccauuaagcucaucgccaugcuguauacaccccuucgcgcuaauaacgccggcgaagauguuuucaccguguccugcagagugcugacacggccuagcccggacuuugauuucauuuuucucgugcccccuaccgucgagucucgcacgaaacccuucaccguuccuauccugacaguggaagagaugaccaacuccagauuucccauuccgcuugagaagcuguucacagggccuagcggagccuucgucgugcagccccagaauggccgguguaccacggacgggguucuccugggaacaacccaacugucuccugugaacaucugcacauuucgcggcgaugucacccauaucgcuggcuccagaaauuacaccaugaaccucgcgagccugaauuggaacaauuaugaccccacagaagagauuccugcuccccuugggacgccggauuucgugggaaaaauccagggcguccugacccagacaaccaagggggacggaucuacacggggccacaaggccaccguguacacgggguccgccccuuuuacacccaaacucggaagcguucaguucuccaccgacaccgaaaacgauuuugagacacaucaaaauaccaaguucacacccgugggcgucauucaggacggcgggacgacccaccgcaacgaaccucagcaaugggugcugccgucuuacagcggaagagauguucacaaugugcaucuugcccccgcugucgccccuacauuucccggcgagcagcuccuguucuuucgguccaccaugccuggguguagcggauaucccaacauggaccuggauugccugcucccucaggagugggugcagcacuucuaccaagaagcggcucccgcccagucugacguggcccugcuucgcuuuguuaauccggauacaggcagaguccuguucgaguguaaacuccauaaguccggguaugugaccguggcucacacgggccagcacgaccuggucaucccucccaacggauacuuucgguucgauagcugggugaaucaguucuauacccuugccccuaugggcaacgggacaggaagacgccgguga

SEQ ID NO: 29422 - RNA, 1617 nt, Artificial Sequence
  derived and/or modified sequence opt5 from VP1__Norovirus_and/or_Norovirus-like__JX459639
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagaaaugugcagaacguucaccuugccccggcuguggcccccaccuuuccuggggagcagcuccuguucuuucggucuacaaugcccggauguuccggcuauccuaauauggaucuggacugccugcucccccaggaguggguccaacauuucuaccaggaagcggcuccugcccagagcgauguggcccugcuucgcuuugugaaccccgacaccgggagaguucuguucgaguguaaacuccacaagucuggauaugucacaguggcucauaccggccagcacgaucuggugaucccgccuaacggguacuuucgguucgacagcugggucaaucaauucuauacgcuugcccccaugggcaacggaaccggcagacgccgguga

SEQ ID NO: 29423 - RNA, 1617 nt, Artificial Sequence
  derived and/or modified sequence opt5 from VP1__Norovirus_and/or_Norovirus-like__JX459609
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgcuguccagccucagaauggccgguguacaaccgacggggugcuccugggaacgacacaacugucucccguuaacaucugcaccuuucgcggcgaugugacacauaucgcgggcuccagaaauuacaccaugaaccucgccagccugaauuggaacaauuaugacccuaccgaagagauucccgcuccucuugggacacccgauuucgucggaaaaauccagggcgugcugacgcagaccacaaagggggacggaucuacccggggccacaaggccacagucuacaccggguccgccccguuuacgccuaaacucggaagcgugcaguucuccacagacaccgaaaacgauuuugagacccaucaaaauacaaaguucacccccguuggcgugauucaggacggcgggacaacgcaccgcaacgaaccccagcaauggguccugccuucuuacagcggaagaaaugugcacaacguucaucuugcuccggccguggcgcccaccuuuccuggcgagcagcuccuguucuuucgguccacaaugcccggguguagcggauauccuaauauggaucuggacugccugcucccccaggaguggguccagcacuucuaccaagaagcugccccugcccagucugauguggcucugcuucgcuuugugaaccccgacaccggcagaguucuguucgaguguaaacuccauaaguccggguaugccacagucgcucacaccggccagcacgaucuggugaucccgccuaacggauacuuucgguucgacagcugggugaaucaguucuauacgcuugcccccaugggcaacgggaccggaagacgccgguga

SEQ ID NO: 29424 - RNA, 1617 nt, Artificial Sequence
  derived and/or modified sequence opt5 from VP1__Norovirus_and/or_Norovirus-like__JN400599
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaucuagagacggcuccacccgggggcacaaggccacggugagcacaggauccguucauuuuaccccuaagcugggcucugugcaguucagcaccgauacauccaaugacuuugagaccgggcagaacacacgcuucacgcccgucggagugguucaagauggcagcaccacacaccagaaugaaccccagcagugggugcucccuaacuacucuggcagagacucccacaauguccaucuggcuccggccguggcccccaccuuuccuggggagcaacuucuguucuuucggagcacaaugcccggauguucuggcuacccuaacaugaaucucgauugccugcugccccaggaaugggugcagcacuucuaucaggagagcgcuccugcccaauccgacguugcgcuccugcgcuuugucaaccccgauaccgggagagugcuuuucgaguguaaacugcauaagccgggauacgugacggucgcucacaccggccagcacgaccucgugauuccucccaacggguauuuucgguucgauucuuggguuaaucaguucuacacacuggccccuaugggcaacggagccggcagacgccgguga

SEQ ID NO: 29425 - RNA, 1617 nt, Artificial Sequence
  derived and/or modified sequence opt5 from VP1__Norovirus_and/or_Norovirus-like__JQ613539
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccacauucgucgugcagccccagaacggacgguguaccacggauggcguucuccuggggacaacccaacugagcccugugaauaucugcacauuucgcggagacgucacccauaucgccggcucucacaacuacaccaugaaucucgccucccagaacuggaauagcuaugaucccacagaggaaauuccugcuccccugggcacgccggacuucguggggaaaauccagggaguccuuacccagacaaccagaacagacggcuccacccgggggcauaaggcgacgguguacacaggaucugccgaguuuagcccuaagcugggccgcguucaauucgcuaccgauaccaacaaugacuuugaugccaaccagaauacaaaauucacccccgugggggucauucaggacggaggcacaacgcacagaaacgaaccccaacagugggugcucccuuccuacagcggccggaauacccacaacguucaucuggccccggcuguggcccccacauuuccuggggagcagcuucuguucuuucgcucuaccaugcccggauguuccggcuauccuaauauggaucucgacugccugaucccccaggaauggguccaauacuucuaucaggaggcggcuccugcccagagcgauguggcccugcucagauuugugaaccccgacacagggcggguucuguucgaguguaaacuucacaagucuggauacgucaccguggcucauacgggccagcacgaucuggugauuccgccuaacggguauuuuagauucgacagcugggucaaucaauucuacacccucgcccccaugggcaacggaacaggccgccggagauga

SEQ ID NO: 29426 - RNA, 1617 nt, Artificial Sequence
  derived and/or modified sequence opt5 from VP1__Norovirus_and/or_Norovirus-like__HQ456329
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuaccucgucccgcccacaguggagucucgcaccaaaccuuuuacgguucccauccugaccguggaagagaugacaaacuccagauucccuauuccccuugagaagcuguuuaccgggccgagcggagccuucgucgugcagccucagaauggccgguguacaaccgacgggguucuccugggaacgacacaacugucucccgugaacaucugcaccuuccgcggcgaugucacacauaucgcuggcuccagaaauuauaccaugaaccucgcgagccugaauuggaacaauuacgacccuaccgaagagauucccgccccucuugggacacccgauuuugugggaaaaauccagggcguccugacgcagaccacaaagggggacggaucuacccggggccacaaggcuacaguguacaccgggggagccccguucacgccuaaacucggcuccguucaguuuagcacagacaccgaaaacgauuucgagacccaucaaaauacaaaguuuacccccgugggcgucauucaggacggguccacaacgcaccgcaacgaaccccagcaaugggugcugccuucuuauagcggaagaaauguucacaacgugcaucuugccccggcugucgcccccaccuucccuggcgagcagcugcucuuuuuccgguccacaaugcccggguguagcggauacccuaauauggaucuggacugccugcucccccaggagugggugcagcacuuuuaucaagaagcggcuccugcccagucugauguggcccugcuucgcuucguuaaccccgacaccggcagaguccuguuugaguguaaacuccauaaguccggguacgugacaguggcucacaccggccagcacgaucuggucaucccgccuaacggauauuuccgguuugacagcugggugaaucaguucuacacgcuugcccccaugggcaacgggaccggaagacgccgguga

SEQ ID NO: 29427 - RNA, 1617 nt, Artificial Sequence
  derived and/or modified sequence opt5 from VP1__Norovirus_and/or_Norovirus-like__HM802536
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuuggggcucccgauuucgugggaaaaauccagggcguccugacacagacgaccaagggggacggaucuacacggggccacaaggccaccguguacacaggguccgccccguuuaccccuaaacucggaagcguucaguucuccacggacacagaaaacgauuuugagacccaucaaaauaccaaguucacacccgugggcgucauucaggacggcucuaccacacaccgcaacgaaccccagcaaugggugcugccuagcuacuccgggagaaauguucacaacgugcaucuugcuccggccgucgcgcccacguuuccuggagagcagcuccuguucuuucggagcaccaugcccggcuguucuggguauccuaauauggaucuggacugccugcucccccaggagugggugcagcacuucuaccaagaagcugccccugcccaguccgauguggcucugcuucgcuuuguuaaccccgacacaggaagaguccuguucgaguguaaacuccauaagagcggcuaugugaccguggcccacacagggcagcacgaucuggucaucccgccuaacggcuacuuucgguucgacucuugggugaaucaguucuauacccuugcucccaugggaaacggcacggggagacgccgguga

SEQ ID NO: 29428 - RNA, 1617 nt, Artificial Sequence
  derived and/or modified sequence opt5 from VP1__Norovirus_and/or_Norovirus-like__HM802532
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugagccucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugagacccaucaaaacacaaaguucacccccgugggcgucauucaggacggcagcacaacgcaccgcaaugaaccccagcaaugggugcugccuuccuacagcgggagaaacguucacaaugugcaucuugccccggcugucgcccccaccuuuccuggagagcagcuccuguucuuucggucuacaaugcccggcuguuccggguauccuaacauggaucuggacugccugcucccccaggagugggugcagcacuucuaccaagaagcggcuccugcccagagcgauguggcccugcuucgcuuuguuaaucccgacaccggaagaguccuguucgaguguaaacuccauaagucuggcuaugugacaguggcucacaccgggcagcacgaucuggucaucccgccuaacggcuacuuucgguucgacagcugggugaaccaguucuauacgcuugcccccaugggaaauggcaccgggagacgccgguga

SEQ ID NO: 29429 - RNA, 1617 nt, Artificial Sequence
  derived and/or modified sequence opt5 from VP1__Norovirus_and/or_Norovirus-like__AB541341
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcaacacaacgcaccgcaaugaaccccagcaauggguccugccuagcuacuccggcagaaacgugcagaauguucaccuugccccggcuguggcccccaccuuuccuggggagcagcuccuguucuuucggagcacaaugcccggauguucuggcuauccuaacauggaucuggacugccugcucccccaggaguggguccaacauuucuaccaggaagcggcuccugcccaguccgauguggcccugcuucgcuuugugaaccccgacaccgggagaguucuguucgaguguaaacuccacaagagcggauaugucacaguggcucauaccggccagcacgaucuggugaucccgccuaauggguacuuucgguucgacucuugggucaaccaauucuauacgcuugcccccaugggcaauggaaccggcagacgccgguga

SEQ ID NO: 29430 - RNA, 1617 nt, Artificial Sequence
  derived and/or modified sequence opt5 from VP1__Norovirus_and/or_Norovirus-like__AB541264
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccgugcugaccgucgaagagaugacaaacuccagauuuccuaucccccuugagaagcuguucaccgggccgagcucugccuucgugguucagccucagaauggacgguguacaaccgacggcgugcuccuggggacgacacaacugucccccgucaacauuugcaccuuucgcggagaugugacacauaucgcuggcagcagagacuacaccaugaaucucgcgucucugaacuggaauaacuaugauccuaccgaagagauccccgccccucuuggcacacccgacuucgucgggaaaauucagggagugcugacgcagaccacacggggcgacggguccacccgcggacacaaggcuacaguuuacaccggcagcgccccguuuacgccuaagcucggguccgugcaguucucuacagauaccgaaaaugacuuugagacccaucaaaacacaaaauucacccccgucggagugauccaggauggcggcacaacgcacagaaaugaaccccagcaauggguucugccuagcuacuccgggcggaacgugccgaauguccaccuugcccccgcuguggccccuaccuuucccggagagcagcuccuguucuuucgcagcacaaugccuggcuguucuggguaucccaacauggaccuggauugccugcucccucaggagugggugcagcauuucuaccaagaagcggcucccgcccaguccgacguugcccugcuuagauuugucaauccggauaccggacgggugcuguucgaguguaagcuccacaaaagcggcuaugugacagucgcucauaccgggcagcacgaccuggugauuccucccaacggcuacuuuagauucgauucuuggguuaaccaguucuauacgcuugccccuaugggaaauggcaccgggcgccggagauga

SEQ ID NO: 29431 - RNA, 1617 nt, Artificial Sequence
  derived and/or modified sequence opt5 from VP1__Norovirus_and/or_Norovirus-like__AB541236
augaagauggccagcaacgacgcuaaucccuccgauggcucugccgcgaaccuggugcaggaggucaauaacgaaguuauggcucucgagccuguggugggggccgccaucgcugccccggucgcuggacaacagaaugugauugaccccuggaucagaaacaauuucguucaggccccuggcggggaauuuaccgugagcccccggaacgcgccuggagagauucugugguccgcuccccuuggcccugaucugaauccguaccucucucaccuggcccgcauguauaacggguacgccggaggcuucgaaguccaggugauccuugcuggcaaugccuuuacagcggggaaaauuaucuucgccgcuguucccccuaacuuucccacggagggacugagcccuucccaagugaccauguucccccauaucauugucgacgugagacagcucgagccggugcugaucccucugcccgauguccggaauaacuuuuaucacuacaaucagucuaacgacagcacaauuaagcucaucgccaugcuguauaccccucuucgcgcuaacaaugccggcgaagauguuuucacaguguccugcagagugcugacccggcccagccccgacuuugauuucauuuuucucgucccuccgacaguggagucucgcaccaaacccuucacgguuccuauccugaccguggaagagaugacaaacuccagauuucccauuccucuugagaagcuguucaccgggcccagcucugccuucgucgugcagccgcaaaauggacgguguacaaccgacggcguucuccuggggacgacacagcuguccccugugaacaucugcaccuuucgcggagaugucacacauaucgcuggcagcagaaauuacauuaugaaccucgcgucucugaauuggaacaauuaugaccccaccgaagagaucccugcuccccuuggcaccccugauuucguggggaaaauucagggaguccugacacagacgaccaagggcgacggguccacacggggacacaaggccaccguguacacaggcagcgcccccuuuaccccgaaacucggguccguucaauucucuacggacacagaaaacgauuuugagacccaucagaauaccaaguucacaccugugggagucauccaggacggcagcaccacacaccgcaacgaaccccaacagugggugcugcccuccuacagcggcgggaauguucacaacgugcaucuugccccugcugucgccccgacguuucccggagagcagcuccuguucuuuagaucuaccaugccuggcuguuccggguaucccaauauggaucuggacugccugcucccucaggagugggugcaacacuucuaccaggaagcggcucccgcccagagcgauguggcccugcuucgguuuguuaacccugacacaggacgcguccuguucgaguguaaacuccauaagucuggcuaugugaccguggcucacacagggcagcacgaucuggucauucccccgaacggcuacuuuagauucgacagcugggugaaucaauucuauacccuugccccuaugggaaacggcacggggcggagacgcuga

SEQ ID NO: 29432 - RNA, 1617 nt, Artificial Sequence
  derived and/or modified sequence opt5 from VP1__Norovirus_and/or_Norovirus-like__AB541208
augaagauggccagcaacgaccccuccccuucugauggcagcgcugccaaucuggugccggaggucaacaaugaaguuauggcgcucgagcccguggugggggcugccaucgccgcuccugucgccggacagcaaaacgugauugaccccuggaucagaaauaacuucguucaggcuccuggcggggaauuuaccgugucuccccggaaugccccuggagagauucugugguccgcgccgcuuggccccgaucugaacccuuaccucagccaccuggcccgcauguauaauggguacgcuggaggcuucgaaguccaggugauccuugccggcaacgcuuuuacagccgggaaaauuaucuucgcggccguucccccuaauuuucccacggagggacuguccccgucucaggugaccauguucccucauaucauugucgacgugagacaacucgagcccgugcugaucccucugcccgauguccggaacaauuuuuaucacuacaaccagagcaaugacuccacaauuaagcucaucgcuaugcuguauacaccccuucgcgccaacaacgcuggcgaagauguuuucaccgugagcugcagagugcugacccggccuucuccggacuuugauuucauuuuucucgugcccccuacagucgagucccgcaccaaacccuucacgguuccuauccugaccguggaagagaugacaaauagcagauuucccauuccgcuugagaagcuguucaccgggccuucuuccgccuucgucgugcagccccagaacggacgguguacaaccgacggcguucuccuggggacgacacaacugagcccugugaauaucugcaccuuucgcggagaugucacacauaucgccggcucuagaaacuacaccaugaaucucgcuucccugaacuggaauaacuaugaccccaccgaagagauuccugcgccccuuggcacaccggauuucguggggaaaauccagggaguccugacgcagaccacaaagggcgacgggagcacccggggacacaaggccacaguguacaccggcuccgcuccuuuuacgcccaaacucgggucuguucaguucagcacagacaccgaaaaugauuuugagacccaucaaaacacaaaguucacccccgugggagucauucaggacggcggcacaacgcaccgcaaugaaccucagcaaugggugcugccguccuacagcgggagagauguucagaacgugcaccuugcccccgccgucgcuccuaccuuucccggagagcagcuccuguucuuucggucuacaaugccuggcuguuccggguaucccaauauggaccuggauugccugcucccucaggagugggugcaacauuucuaccaggaagccgcgcccgcucagagcgacguggcccugcuucgcuuuguuaacccggauaccggaagaguccuguucgaguguaaacuccacaagucuggcuaugugacaguggcccauaccgggcagcacgaccuggucaucccucccaauggcuacuuucgguucgauagcugggugaaccaauucuauacgcuugcuccuaugggaaacggcaccgggagacgccgguga

SEQ ID NO: 29433 - RNA, 1617 nt, Artificial Sequence
  derived and/or modified sequence opt5 from VP1__Norovirus_and/or_Norovirus-like__EU876890
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaagauucacgcccgucggagugguucaagauggcuccaccacacaccagaaugaaccccagcagugggugcucccugacuacagcggccgggauucucacaacguccaucuggcuccggccguggcccccaauuuuccuggggagcaacuucuguucuuucgcuccaccaugcccggauguagcggcuacccuaacaugaaucucgacugccugcugccccaggaaugggugcagcacuucuaucaggagucugcuccugcccaaagcgauguugcgcuccugagauuugucaaccccgacacagggcgggugcuuuucgaguguaaacugcauaaguccggauacgugaccgucgcucacacgggccagcacgaucucgugauuccgccuaacggguauuuuagauucgacucuuggguuaaucaguucuacacccuggcccccaugggcaacggagccggccgccggagauga

SEQ ID NO: 29434 - RNA, 1617 nt, Artificial Sequence
  derived and/or modified sequence opt5 from VP1__Norovirus_and/or_Norovirus-like__AB385638
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccaacacccaggaguacaccaugaaucucgcuucccagaacuggaauaacuaugaucccacagaagagauuccugcgccccugggaacgccggacuucgugggcaaaauccagggcguccuuacccaaacaaccagacgggacgggagcacacgcggacacaaggccaccguguccacgggcucuguucauuuuacaccuaagcuggggcggauucaguucagcaccgauaccuccaaugacuuugaaacaggacagaacaccagauucacacccgugggcgucgugcaagaugggagcacgacccaccagaaugagccccagcaguggguucucccuaacuacucuggaggcgacggccacaaugugcaucuggcuccggccgucgcccccuccuuuccuggggaacaacuucuguucuuucgcagcacaaugcccggauguucuggcuacccuaacaugaaucucgauugccugcugccccaggagugggugcagcacuucuaucaggaggcugccccugcgcaaagcgacguggcucuccugagauuuguuaaccccgauaccgggcggguccuuuucgaauguaaacugcauaaguccggauacgugacaguggcccacaccggccagcacgaccucgucaucccgccuaacggguauuuuagauucgauucuugggugaaucaguucuacacgcuggcccccaugggcaacggaaccggccgccggagauga

SEQ ID NO: 29435 - RNA, 1617 nt, Artificial Sequence
  derived and/or modified sequence opt5 from VP1__Norovirus_and/or_Norovirus-like__AB385635
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgauagcugcagagugcugacccggccuuccccggacuuugauuucauuuuucucgugcccccuacggucgaaagccgcaccaaacccuucucugugccuauccugacaguugaggaaaugaccaauuccagauuucccauuccgcuugagaagcuguucacagggccuagcucugccuucgugguccagccccagaacggacgguguaccacggacggcgugcuccuggggacaacccaacuguccccuguuaauaucugcacauuucgcggagaugugacccauaucgccggcacccagaacuacacaaugaaucucgcuagccagaacuggaauaacuaugaccccacggaggaaauuccugcgccccugggcaccccggacuucgucgggaaaauccagggagugcuuacacaaaccacaagacgggauggcucuacccgcgggcacaaggccacggucuccacaggaagcgugcauuuuaccccuaagcugggcuccguucaguucucuaccgacacaagcaaugaucucgagaccgggcagaacacaagauuuacgcccgugggagucgugcaagacggcuccaccacacaccagaaugaaccccagcaguggguucugccugauuacagcggccgggacucucacaacgugcaucuugcuccggccgucgcccccaccuucccuggggagcaacugcucuuuuuccgcuccacaaugcccggauguagcggcuacccuaauaugaaccuggauugccugcucccccaggaaugggugcagcacuuuuaucaggagucugcuccugcccaaagcgacguggcgcugcuuagauucguuaaucccgauaccgggcggguccuguuugaguguaaacuccauaaguccggauacgugacgguggcucacaccggccagcacgaccuggucauuccgccuaacggguauuucagauuugauucuugggugaaccaguucuacacacuugcccccaugggcaauggagccggccgccggagauga

SEQ ID NO: 29436 - RNA, 1617 nt, Artificial Sequence
  derived and/or modified sequence opt5 from VP1__Norovirus_and/or_Norovirus-like__EU366113
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucagucuagcacagacaccgaaaacgauuucgagacccaucaaaauacaaaguuuacccccgugggagucauucaggacggcuccacaacgcaccgcaacgaaccccagcaaugggugcugccuagcuacucuggcagaaauguucacaacgugcaucuugccccggcugucgcccccaccuucccuggggagcagcugcucuuuuuccgguccacagugcccggauguagcggcuauccuaauauggaucuggacugccugcucccccaggagugggugcagcacuuuuaccaagaagcggcuccugcccagucugauguugcccugcuucgcuucgucaaccccgacaccgggagagugcuguuugaguguaaacuccauaagagcggauaugugacagucgcucacaccggccagcacgaucuggugaucccgccuaacggguacuuccgguuugacuccuggguuaaucaguucuauacgcuugcccccaugggcaacggaaccggcagacgccgguga

SEQ ID NO: 29437 - RNA, 1617 nt, Artificial Sequence
  derived and/or modified sequence opt5 from VP1__Norovirus_and/or_Norovirus-like__KX354097
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaaagaccgacggcagcacaagagggcauaaggccaccgucuacacgggauccgcugauuuugccccuaaacugggccgggugcaauucgagacagacaccaaucacgauuuugaagccaaccagaauaccaaguucacacccguuggggugauccaggacggaucuaccacacaccgcaacgagccccaacaguggguccucccuagcuacuccggcagaaauacgcauaacgugcaccuggcuccggccguggcgcccaccuuuccuggcgaacagcuucuguucuuucggagcacaaugcccggguguucuggauauccuaauauggaucucgacugccugcugccccaggaguggguucaauacuucuaucaggaggcugccccugcccaguccgaugucgcucuccugcgcuuugugaaccccgacaccggcagagugcuuuucgaauguaaacugcauaagagcggguacgucacaguggcccacaccggacagcacgaucucguuauuccgccuaacggcuauuuucgguucgacucuugggugaaucaauucuacacgcuggcucccauggggaacggcaccggaagacgccgguga

SEQ ID NO: 29438 - RNA, 1617 nt, Artificial Sequence
  derived and/or modified sequence opt5 from VP1__Norovirus_and/or_Norovirus-like__AB933727
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagaggugcccgccccucuuggcacacccgauuucgucgggaaaauucagggagugcugacgcagaccacaaagggcgacggguccacccggggacacaaggcuacaguuuacaccggcagcgccccguuuacgccuaaacucggguccgugcaguucucuacagacaccgaaaacgauuuugagacccaucaaaauacaaaguucacccccgucggagugauccaggacggcggcacaacgcaccgcaacgaaccccagcaauggguucugccuagcuacuccgggagagaugugccgaauguccaccuugcccccgcuguggccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguugcccugcuucgcuuugucaauccggauaccggaagagugcuguucgaguguaaacuccacaagagcggcuaugugacagucgcucauaccgggcagcacgaccuggugauuccucccaacggcuacuuucgguucgauucuuggguuaaccaguucuauacgcuugccccuaugggaaauggcaccgggagacgccgguga

SEQ ID NO: 29439 - RNA, 1617 nt, Artificial Sequence
  derived and/or modified sequence opt5 from VP1__Norovirus_and/or_Norovirus-like__AB933726
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagaaaugugccgaacguucaccuugcccccgcuguggccccuaccuuucccggggagcagcuccuguucuuucggucuacaaugccuggauguuccggcuaucccaauauggaucuggacugccugcucccucaggaguggguccagcauuucuaccaagaagcggcucccgcccagagcgauguggcccugcuucgcuuugugaacccggacaccgggagaguucuguucgaguguaaacuccacaagucuggauaugucacaguggcucauaccggccagcacgaucuggugaucccucccaacggguacuuucgguucgacagcugggucaaucaguucuauacgcuugccccuaugggcaacggaaccggcagacgccgguga

SEQ ID NO: 29440 - RNA, 1617 nt, Artificial Sequence
  derived and/or modified sequence opt5 from VP1__Norovirus_and/or_Norovirus-like__AB933720
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaguccagggagugcugacgcagaccacaaagggcgacgggagcacccggggacacaaggcuacaguuuacaccggcuccgccccguuuacgccuaaacucgggucugugcaguucagcacagacaccgaaaaugauuuugagacccaucaaaacacaaaguucacccccgucggagugauccaggacggcuccacaacgcaccgcaaugaaccccagcaauggguucugccuagcuacucuggcagaaacgugccgaauguccaccuugcccccgcuguggccccuaccuuucccggggagcagcuccuguucuuucgguccacaaugccuggauguagcggcuaucccaacauggaucuggacugccugcucccucaggagugggugcagcauuucuaccaagaagcggcucccgcccagucugauguugcccugcuucgcuuugucaauccggacaccgggagagugcuguucgaguguaaacuccacaagagcggauaugugacagucgcucauaccggccagcacgaucuggugauuccucccaacggguacuuucgguucgacuccuggguuaaccaguucuauacgcuugccccuaugggcaauggaaccggcagacgccgguga

SEQ ID NO: 29441 - RNA, 1617 nt, Artificial Sequence
  derived and/or modified sequence opt5 from VP1__Norovirus_and/or_Norovirus-like__AB933691
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagagaugugccgaauguucaccuugcccccgcuguggccccuaccuuucccggggagcagcuccuguucuuucggucuacaaugccuggauguuccggcuaucccaacauggaccuggauugccugcucccucaggaguggguccagcauuucuaccaagaagcggcucccgcccagagcgacguggcccugcuucgcuuugugaauccggauaccgggagaguucuguucgaguguaaacuccacaagucuggauaugucacaguggcucauaccggccagcacgaccuggugaucccucccaacggguacuuucgguucgauagcugggucaaccaguucuauacgcuugccccuaugggcaauggaaccggcagacgccgguga

SEQ ID NO: 29442 - RNA, 1617 nt, Artificial Sequence
  derived and/or modified sequence opt5 from VP1__Norovirus_and/or_Norovirus-like__AB933682
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcucugccuucgucgugcagccucagaauggacgguguaccacggacggcguucuccuggggacaacccaacugucccccgugaacaucugcacauuucgcggagaugucacccauaucgccggcagccacaauuacaccaugaaccucgcuucucugaauuggaacaauuaugacccuacagaagagauucccgcgccucuuggcacgcccgauuucguggggaaaauccagggaguccugacccagacaaccaagggcgacggguccacaagaggacauaaggccaccguguacacgggcagcgcuccguuuacaccuaaacucggguccguucaguucucuaccgacaccgaaaacgauuuugagacacaccaaaauaccaaguucacacccgugggagucauucaggacggcggcacgacccaccggaacgaaccccagcaaugggugcugccuagcuacuccgggcgcaauguucagaacgugcaucuugccccggccgucgcucccacauuuccuggagagcagcuccuguucuuuagaagcaccaugcccggcuguucuggguauccuaauauggaucuggacugccugcucccccaggagugggugcaacacuucuaccaggaagccgcgccugcucaguccgauguggcccugcuucgguuuguuaaccccgacacaggacgcguccuguucgaguguaaacuccauaagagcggcuaugugaccguggcccacacggggcagcacgaucuggucaucccgccuaacggcuacuuuagauucgacucuugggugaaucaauucuauacccuugcucccaugggaaacggcacagggcggagacgcuga

SEQ ID NO: 29443 - RNA, 1617 nt, Artificial Sequence
  derived and/or modified sequence opt5 from VP1__Norovirus_and/or_Norovirus-like__KM245069
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccuccacccaggaguacaccaugaaccucgcuagccagaauuggaacaauuaugaucccacagaagagauuccugcgccccugggaacgccggacuucgugggcaaaauccagggcguccuuacccaaacaaccagacgggacggguccacacgcggacacaaggccaccgugucuacgggcagcguucauuuuacaccuaagcuggggcggauucaguucuccaccgauaccagcaacgacuuugaaacaggacagaauaccagauucacacccgugggcgucgugcaagaugggucuacgacccaccagaacgagccccagcaguggguucucccuaauuacuccggacgcgacagccacaacgugcaucuggcuccggccgucgcccccucuuuuccuggcgaacaacuucuguucuuuagaagcacaaugcccggcuguuccggguacccuaauaugaaccucgauugccugcugccccaggagugggugcagcacuucuaucaggaggcugccccugcgcaaucugacguggcucuccugcgguuuguuaaucccgauaccggaagaguccuuuucgaauguaaacugcauaagagcggcuacgugacaguggcccacaccgggcagcacgaccucgucaucccgccuaacggauauuuucgcuucgauuccugggugaaccaguucuacacgcuggcccccaugggcaaugggaccggccggagacgcuga

SEQ ID NO: 29444 - RNA, 1617 nt, Artificial Sequence
  derived and/or modified sequence opt5 from VP1__Norovirus_and/or_Norovirus-like__LC005717
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucaaaaacaauuucguucaggcccccggcggggaauuuaccgugagcccuagaaacgcgcccggagagauucugugguccgccccucuuggcccggaucugaaucccuaccucucucaccuggcucggauguauaacggguacgccggaggcuucgaaguccaggugauccuugcuggcaaugccuuuacagcggggaagauuaucuucgccgcuguuccucccaacuuuccuacggagggacugagccccucccaggugaccauguucccgcauaucauugucgacgugcgccaacucgagccugugcugaucccccugccugaugucagaaauaacuuuuaucacuacaaucagucuaacgacagcacaauuaaacucaucgccaugcuguauacaccccuucgggcuaacaaugccggcgaagauguuuucaccguguccugccgcgugcugaccagacccagcccugacuuugauuucauuuuucucgucccgcccacaguggagucucggaccaagccuuucacgguucccauccugaccguggaagagaugacaaacucccgcuuuccuauuccccuugagaaacuguucaccgggccgagcggagccuucgucgugcagccucagaauggcagauguacaaccgacgggguucuccugggaacgacacaacugucucccgugaacaucugcaccuuucggggcgaugucacacauaucgcuggcucccgcaauuacaccaugaaccucgcggcccugaauuggaacaauuaugacccuaccgaagagauucccgcuccucuugggacacccgauuucgugggaaagauccagggcguccugacgcagaccacaaagggggacggaagcaccagaggccacaaagccacaguguacaccgggucugccgacuuuacgccgaagcucggauccguucaguucagcacagauaccgaaaacgacuuugagacccaucaaaauacaaaauucaccccugugggcgucauucaggauggcuccacaacgcaccggaacgaaccccagcaaugggugcugcccucuuacagcgggcgcaauguucacaacgugcaucuugcuccugccgucgcgccgaccuuucccggagagcagcuccuguucuuuagauccacaaugccuggcuguagcggguaucccaauauggaccuggauugccugcucccucaggagugggugcagcacuucuaccaagaagcugcccccgcccagucugacguggcucugcuucgguuuguuaacccugauaccggacgcguccuguucgaguguaagcuccauaaauccggcuaugugacaguggcccacaccgggcagcacgaccuggucauucccccgaacggcuacuuuagauucgauagcugggugaaucaguucuauacgcuugcuccuaugggaaacggcaccgggcggagacgcuga

SEQ ID NO: 29445 - RNA, 1617 nt, Artificial Sequence
  derived and/or modified sequence opt5 from VP1__Norovirus_and/or_Norovirus-like__LC005705
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaauuuacaccggguccgccccguuuacgccuaaacucggaagcgugcaguucuccacagacaccgaaaacgauuuugagacccaucaaaauacaaaguucacccccguuggcgugauccaggacggcucuacaacgcaccgcaacgaaccccagcaauggguccugccuagcuacuccgggagaaaugugcacaacguucaucuugccccggcuguggcccccaccuuuccuggagagcagcuccuguucuuucggagcacaaugcccggcuguucuggguauccuaauauggaucuggacugccugcucccccaggaguggguccagcacuucuaccaagaagcggcuccugcccaguccgauguggcccugcuucgcuuugugaaccccgacaccggaagaguucuguucgaguguaaacuccauaagagcggcuaugucacaguggcucacaccgggcagcacgaucuggugauuccgccuaacggcuacuuucgguucgacucuugggucaaucaguucuauacgcuugcccccaugggaaacggcaccgggagacgccgguga

SEQ ID NO: 29446 - RNA, 1617 nt, Artificial Sequence
  derived and/or modified sequence opt5 from VP1__Norovirus_and/or_Norovirus-like__KC894943
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuaauuacagcggguccgauguuccgaacgugcaccuugcccccgcugucgccccuaauuuucccggagagcagcuccuguucuuuagaagcaccaugccuggcuguucuggguaucccaacauggaccuggauugccugcucccucaggagugggugcagcauuucuaccaagaagcggcucccgcccaguccgacguggcccugcuucgguuuguuaacccggauacaggacgcguccuguucgaguguaaacuccacaagagcggcuaugugaccguggcucauacagggcagcacgaccuggucaucccucccaauggcuacuuuagauucgauucuugggugaaccaguucuauacccuugccccuaugggaaauggcacggggcggagacgcuga

SEQ ID NO: 29447 - RNA, 1617 nt, Artificial Sequence
  derived and/or modified sequence opt5 from VP1__Norovirus_and/or_Norovirus-like__KF060023
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgggacagacaccgaucaugacuuugaggccaaccagaauaccaaauucacacccguuggagugauccaggauggcagcaccacacaccggaacgaaccccaacaguggguccucccuuccuacagcggccgcaauacgccgaacgugcaccuggcucccgccguggcgccuaccuuucccggggagcagcuucuguucuuuagaucuacaaugccuggauguuccggcuaucccaauauggaccucgauugccugcugccucaggaauggguucaauacuucuaucaggaggcugcccccgcccagagcgacgucgcucuccugcgguuugugaacccggauaccgggagagugcuuuucgaguguaagcugcauaaaucuggauacgucacaguggcccacaccggccagcaugaccucguuauuccucccaauggguauuuucgcuucgauagcugggugaaccaauucuacacgcuggcuccuaugggcaacggaaccggccggagacgcuga

SEQ ID NO: 29448 - RNA, 1617 nt, Artificial Sequence
  derived and/or modified sequence opt5 from VP1__Norovirus_and/or_Norovirus-like__KC409310
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugaccccaccauuaagcucaucgccaugcuguauacaccccuucgcgcuaacaacgccggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaauucuagauuucccauuccgcuugagaagcuguucacagggccuuccggagccuucgucgugcagccccagaacggccgguguaccacggacgggguucuccugggaacaacccaacugagcccugugaauaucugcacauuucgcggcgaugucacccauaucgcuggcucuagaaacuacaccaugaaucucgcgucccugaacuggaauaacuaugaccccacagaagagauuccugcuccccuugggacgccggauuucgugggaaaaauccagggcguccugacccagacaaccaagggggacggaagcacacggggccacaaggccaccguguacacggggucugccccuuuuacacccaaacucggauccguucaguucagcaccgacaccgaaaaugauuuugagacacaucaaaacaccaaguucacacccgugggcgucauucaggacggcgggacgacccaccgcaaugaaccucagcaaugggugcugccguccuacucuggaagagauguucacaacgugcaucuugcccccgcugucgccccuacauuucccggcgagcagcuccuguucuuucggagcaccaugccuggguguuccggauaucccaauauggaccuggauugccugcucccucaggagugggugcagcacuucuaccaagaagcggcucccgcccagagcgacguggcccugcuucgcuuuguuaacccggauacaggcagaguccuguucgaguguaaacuccauaagucuggguaugugaccguggcucacacgggccagcacgaccuggucaucccucccaauggauacuuucgguucgauuccugggugaaccaguucuauacccuugccccuaugggcaacgggacaggaagacgccgguga

SEQ ID NO: 29449 - RNA, 1617 nt, Artificial Sequence
  derived and/or modified sequence opt5 from VP1__Norovirus_and/or_Norovirus-like__JX989073
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagagauaucccgaaugugcaccuugcccccgcuguugccccuaccuuucccggggagcagcuccuguucuuucggucuacaaugccuggauguuccggcuaucccaacauggaccuggauugccugcucccucaggagugggugcagcauuucuaccaagaagcggcucccgcccagagcgacgucgcccugcuucgcuuugugaauccggauaccgggagagugcuguucgaguguaaacuccacaagucuggauauguuacagucgcucauaccggccagcacgaccuggugauuccucccaacggguacuuucgguucgauagcugggugaaccaguucuauacgcuugccccuaugggcaauggaaccggcagacgccgguga

SEQ ID NO: 29450 - RNA, 1617 nt, Artificial Sequence
  derived and/or modified sequence opt5 from VP1__Norovirus_and/or_Norovirus-like__JX459902
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccucuuuuccuaucgagggacugagccccucccaggugaccauguucccgcauauuaucgucgacgugagacaacucgagccugugcugauuccccugccugauguccggaacaauuuuuaucacuacaaccagagcaaugaccccacaaucaagcucauugcuaugcuguauacaccccuucgcgccaacaaugcuggcgaugacguuuucaccgugucuugcagagugcugacccggccuuccccggauuuugacuucaucuuucucgugcccccuacagucgaaagccgcaccaaacccuucucuguuccugugcugacggucgaggaaaugaccaacuccagauuucccauuccgcuugagaagcuguucacagggccuagcucugccuucgugguucagccccagaacggacgguguaccacagauggcgugcuccuggggaccacgcaacuguccccugucaauaucugcacauuucgcggaaacgugacccauaucagcggcuccagaaauuacacaaugaaccucgccucucagaauuggaacagcuaugaccccaccgaggaaauuccugcuccccugggcaccccggauuucgucgggaaaauccagggagugcuuacacagacgaccaagacaaauggcuccacccgggggcacaaggcgacaguuuacaccggaagcgccgacuuuucuccuaaacugggccgcgugcaauucgcuacggacacagauaacgacuuugagaccaaucagaacaccaaguucacacccgucggggugauucaggauggauccaccacacccagaaaugaaccucaacaguggguucucccgagcuacucuggccggaacacgcauaaugugcaccuggcccccgccgucgcuccuaccuuucccggcgagcagcuucuguucuuucgcagcacaaugccuggguguuccggauaucccaacauggaccucgauugccugcugccucaggaaugggugcaauacuucuaucaggaggccgcgcccgcucagucugacguggcccuccugagauuuguuaauccggauaccggccggguccuuuucgaguguaaacugcacaagagcggguacgugacaguggcccauaccggacagcacgaccucgucaucccucccaacggcuauuuuagauucgauuccugggugaaccaauucuacacgcuggcuccuauggggaauggcaccggacgccggagauga

SEQ ID NO: 29451 - RNA, 1617 nt, Artificial Sequence
  derived and/or modified sequence opt5 from VP1__Norovirus_and/or_Norovirus-like__JX459644
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcggcccugaauuggaacaauuaugacccuaccgaagagauucccgcuccucuugggacacccgauuucgugggaaaaauccagggcguccugacgcagaccacaaagggggacggaagcacccggggccacaaggccacaguguacaccgggucugccgacuuuacgccgaaacucggauccguucaguucagcacagauaccgaaaacgacuuugagacccaucaaaauacaaaguucaccccugugggcgucauucaggauggcuccacaacgcaccgcaacgaaccccagcaaugggugcugcccucuuacagcgggagaaauguucacaacgugcaucuugcuccugccgucgcgccgaccuuucccggagagcagcuccuguucuuucgguccacaaugccuggcuguagcggguaucccaauaugaaccuggacugccugaucccucaggagugggugcagcacuucuaccaagaagcugcccccgcccagucugauguggcucuccugcgcuuuguuaacccugacaccggaagaguccuuuucgaguguaaacugcauaaguccggcuaugugacaguggcccacaccgggcagcacgaucucgucauucccccgaauggcuacuuucgguucgacagcugggugaaccaguucuauacgcuggcuccuaugggaaauggcgccgggagacgccgguga

SEQ ID NO: 29452 - RNA, 1617 nt, Artificial Sequence
  derived and/or modified sequence opt5 from VP1__Norovirus_and/or_Norovirus-like__JX459610
augaagauggccagcaacgacgcucaccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccgugagcccucggaaugcgcccggagagauucugugguccgccccucuuggcccggaucugaaccccuaccucucucaucuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcacaucauugucgacgugagacaacucgagccugugcugaucccccugccugauguccggaacaauuuuuaucauuacaaccagucuaaugacagcacaauuaagcucaucgccaugcuguauacaccccuucgcgcuaacaacgccggcgaagauguuuucaccguguccugcagagugcugacccggcccagcccugacuuugauuucauuuuucucgucccgcccacaguggagucucgcaccaaaccuuucacgguucccauccugaccguggaagagaugacaaauuccagauuuccuauuccccuugagaagcuguucaccgggccgagcggagccuucgucgugcagccucagaacggccgguguacaaccgacgggguucuccugggaacgacacaacugucucccgugaauaucugcaccuuucgcggcgaugucacacacaucgcuggcuccagaaacuacaccaugaaucucgcgagccugaacuggaccaauuaugacccuacagaagagauucccgccccucuugggacgcccgauuucgugggaaaaauccagggcguccugacccagacaaccaagggggacggaucuacacggggccauaaggcuaccguguacacgggguccgccccguuuacaccuaaacucggaagcguucaguucuccaccgacaccgaaaacgauuuugagacacaccaaaauaccaaguucacacccgugggcgucauucaggacggcgggacgacccaccgcaacgaaccccagcaaugggugcugccuucuuacagcggaagaaauguucauaacgugcaccuugccccggcugucgcccccacauuuccuggcgagcagcuccuguucuuucgguccaccaugcccggguguagcggauauccuaauauggaucuggacugccugcucccccaggagugggugcagcauuucuaccaagaagcggcuccugcccagucugauguggcccugcuucgcuuuguuaaccccgacacaggcagaguccuguucgaguguaaacuccacaaguccggguaugugaccguggcucacacgggccagcaugaucuggucaucccgccuaauggauacuuucgguucgacagcugggugaaccaguucuauacccuugcccccaugggcaacgggacaggaagacgccgguga

SEQ ID NO: 29453 - RNA, 1617 nt, Artificial Sequence
  derived and/or modified sequence opt5 from VP1__Norovirus_and/or_Norovirus-like__JX459606
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucuguggcgcgccccucuuggcccggaucugaaucccuaccucucccaccuggcuagaauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugcggcaacucgagccugugcugaucccccugccugauguccgcaauaacuuuuaucacuacaaucaguccaacgacucuacaauuaagcucaucgccaugcuguauacaccccuuagagcuaacaaugccggcgaagauguuuucaccgugagcugccgggugcugacccgccccuccccugacuuugauuucauuuuucucgucccgcccacaguggagagcagaaccaaaccuuucacgguucccauccugaccguggaagagaugacaaacucucgguuuccuauuccccuugagaagcuguucaccgggccguccagcgccuucgucgugcagccucagaauggacgcuguacaaccgacggcguucuccuggggacgacacaacugucucccgugaacaucugcaccuuuagaggagaugucacacauaucgcuggcucccggaauuacaccaugaaccucgcgagccugaauuggaacaauuaugacccuaccgaagaggugcccgccccucuuggcacacccgauuucgucgggaaaauucagggagugcugacgcagaccacaaagggcgacgggucuacccgcggacacaaggcuacaguuuacaccggcuccgccccguuuacgccuaaacucgggagcgugcaguucuccacagacaccgaaaacgauuuugagacccaucaaaauacaaaguucacccccgucggagugauccaggacggcucuacaacgcacagaaacgaaccccagcaauggguucugccuagcuacuccggccggaaugugcacaacguccaucuugccccggcuguggcccccaccuuuccuggggagcagcuccuguucuuucgcagcacaaugcccggauguucuggcuauccuaauauggaucuggacugccugcucccccaggagugggugcagcacuucuaccaagaagcggcuccugcccaguccgauguugcccugcuuagauuugucaaccccgacaccgggcgggugcuguucgaguguaaacuccauaagagcggauaugugacagucgcucacaccggccagcacgaucuggugauuccgccuaacggguacuuuagauucgacucuuggguuaaucaguucuauacgcuugcccccaugggcaacggaaccggccgccggagauga

SEQ ID NO: 29454 - RNA, 1617 nt, Artificial Sequence
  derived and/or modified sequence opt5 from VP1__Norovirus_and/or_Norovirus-like__JX445159
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacagaaggcgacggguccacccggggacacaaggcuacaguguacaccggcagcgccccguuuacgccuaagcucggguccguucaguucucuacagacaccgagaacgauuuugaaacccaucaaaauacaaaauucacccccgugggagucauucaggacggcagcacaacgcaccgcaacgagccccagcaaugggugcugccuuccuacagcggcagaaauguucacaacgugcaucuugccccggcugucgcccccaccuuuccuggggagcagcuccuguucuuucggucuacaaugcccggauguuccggcuauccuaauauggaucuggacugccugcucccccaggaaugggugcagcacuucuaccaagaggcggcuccugcccagagcgauguggcccugcuucgcuuuguuaaccccgacaccgggagaguccuguucgaauguaagcuccauaaaucuggauaugugacaguggcucacaccggccagcacgaucuggucaucccgccuaacggguacuuucgguucgacagcugggugaaucaguucuauacgcuugcccccaugggcaacggaaccggcagacgccgguga

SEQ ID NO: 29455 - RNA, 1617 nt, Artificial Sequence
  derived and/or modified sequence opt5 from VP1__Norovirus_and/or_Norovirus-like__JN400606
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcggggccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuaugugacaguggcucacaccgggcagcacgaucuggucaucccgccuaacggcuacuuucgguucgacucuugggugaaucaguucuauacgcuugcccccaugggaaacggcaccgggagacgccgguga

SEQ ID NO: 29456 - RNA, 1617 nt, Artificial Sequence
  derived and/or modified sequence opt5 from VP1__Norovirus_and/or_Norovirus-like__JQ613562
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaauccuucacgguuccuauccugaccguggaggaaaugacaaacagcagauuucccauuccucuugagaagcuguucaccgggcccucuuccgccuucgucgugcagccgcagaauggacgguguacaaccgauggcguucuccuggggacgacacaacugagcccugugaacaucugcaccuuucgcggagacgucacacauaucgcuggcucuagaaauuacaccaugaaccucgcgucccugaauuggaacaauuaugaucccaccgaggaaauuccugcuccccuuggcacaccugacuucguggggaaaauccagggaguccugacgcagaccacaaagggcgacgggagcacccggggacacaaggccacaguguacaccggcuccgccgauuuuacgcccaaacucgggucuguucaguucggaacagacaccgauaacgacuuugagacccaucaaaauacaaaguucaccccggugggcgucauucaggauggcagcacaacgcaccgcaacgaaccucagcaaugggugcugcccuccuacagcgggagaaauguucacaacgugcaucuugcccccgcugucgccccuaauuuuccgggagagcagcuccuguucuuucggucuaccaugcccggcuguuccggguauccuaacauggaccuggauugccugcucccccaggaaugggugcagcacuucuaccaagaggcggcuccugcccagagcgacguggcccugcuucgcuuuguuaaccccgauacaggaagaguccuguucgaguguaaacuccauaagucuggcuaugugaccguggcucacacagggcagcacgaccuggucaucccucccaauggcuacuuucgguucgauagcugggugaaccaguucuauacccuugccccgaugggaaauggcgcugggagaaaacgcuga

SEQ ID NO: 29457 - RNA, 1617 nt, Artificial Sequence
  derived and/or modified sequence opt5 from VP1__Norovirus_and/or_Norovirus-like__HQ456343
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucgccacagacaccgagaacgauuuugaaacccaucaaaauacaaaguucaccccugugggagucauucaggacggcucuacaacgcaccgcaacgagccccagcaaugggugcccccuagcuacuccggcagaaauguucacaacgugcaucuggcuccggccgucgcgcccaauuuuccuggggaacagcuucuguucuuucggagcaccaugcccggauguucuggcuauccuaacauggaucucgacugccugcugccccaggagugggugcagcacuucuaccaagaggcugccccugcccaguccgauguggcucuccugcgcuuuguuaaccccgacacagggagaguccuuuucgaauguaaacugcauaagagcggauaugugaccguggcccacacaggccagcacgaucucgucaucccgccuaauggguacuuucgguucgacucuugggugaaccaguucuauacccuggcucccaugggcaauggaacgggcagacgccgguga

SEQ ID NO: 29458 - RNA, 1617 nt, Artificial Sequence
  derived and/or modified sequence opt5 from VP1__Norovirus_and/or_Norovirus-like__HQ456342
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggaggcacagcccaucggaaugagccccaacagugggugcucccuucuuacagcggccgcaacucccacaauguucaccuggcgccggcuguggcccccacguuuccuggggaacagcuucuguucuuuagaagcaccaugcccggauguucuggcuauccuaacauggaucucgacugccugcugccccaggaguggguccaauacuucuaucaggaagccgcuccugcccaguccgauguggcucuccugcgguuugugaaucccgacacagggagaguucuuuucgaguguaagcugcauaaaagcggauacgucaccguggcccacacaggccagcaugaucucgugaucccgccuaacggguauuuucgcuucgacucuugggucaaccaauucuacacccuggcgcccaugggcaauggaacgggccggagacgcuga

SEQ ID NO: 29459 - RNA, 1617 nt, Artificial Sequence
  derived and/or modified sequence opt5 from VP1__Norovirus_and/or_Norovirus-like__HQ456340
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacuguccucuagccaggugaccauguucccccauaucauugucgacgugagacaacucgagccggugcugaucccucugcccgauguccggaacaauuuuuaucacuacaaccaguccagcgacucuacaauuaagcucaucgccaugcuguauaccccucuucgcgcuaauaacgccggcgaagauguuuucacaguguccugcagagugcugacccggcccagccccgacuuugauuucauuuuucucgucccuccgacaguggagucucgcaccaaacccuucacgguuccuauccugaccguggaagagaugacaaacuccagauuucccauuccucuugagaagcuguucaccgggcccagcggagccuucgucgugcagccgcagaauggccgguguacaaccgacgggguucuccugggaacgacacaacugucuccugugaacaucugcaccuuucgcggcgaugucacacauaucgcuggcuccagaaauuacaccaugaaccucgcggcccugaauuggaacaauuaugaccccaccgaagagauuccugcuccccuugggacaccugauuucgugggaaaaauccagggcguccugacgcagaccacaaaggccgacgggagcacccggggacacaaggccacaguguacaccggcuccgcugacuuuacgcccaaacucgggucuguucaguucagcacagauaccgaaaacgacuuugagacccaucaaaauacaaaguucaccccggugggagucauucaggauggcuccacaacgcaccgcaacgaaccucagcaaugggugcugcccagcuacucuggcagaaauguucacaacgugcaucuugcccccgcggucgcuccuaccuuuccgggggagcagcuccuguucuuucgguccacaaugcccggauguagcggcuauccuaauauggaccuggauugccugcucccccaggagugggugcagcacuucuaccaagaagccgccccugcucagucugacguggcccugcuucgcuuuguuaaccccgauaccgggagaguccuguucgaguguaaacuccauaagagcggauaugugacaguggcucacaccggccagcacgaccuggucaucccucccaauggguacuuucgguucgauuccugggugaaccaguucuauacgcuugccccgaugggcaacggaaccggcagacgccgguga

SEQ ID NO: 29460 - RNA, 1617 nt, Artificial Sequence
  derived and/or modified sequence opt5 from VP1__Norovirus_and/or_Norovirus-like__HQ456326
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucgucguggacgugagacaacucgagccuguccugauuccccugccugauguucggaauaacuuuuaucacuacaaucagucuaacgacagcacaaucaagcucauugccaugcuguauacaccccuucgcgcuaacaaugccggcgaagauguguucaccguguccugcagaguccugacccggcccagcccugacuuugauuucaucuuucucgugccgcccacaguugagucucgcaccaaaccuuucacggugcccauucugaccgucgaagagaugacaaacuccagauuuccuaucccccuugagaagcuguucaccgggccgagcggagccuucgugguucagccucagaauggccgguguacaaccgacggggugcuccugggaacgacacaacugucucccgucaacauuugcaccuuucgcggcgaugugacacauaucgcuggcuccagaaauuacaccaugaaccucgcgagccugaauuggaacaauuaugacccuaccgaagagauccccgccccucuugggacacccgauuucgucggaaaaauucagggcgugcugacgcagaccacaaagggggacggaucuacccggggccacaaggcuacaguuuacaccggguccgccccguuuacgccuaaacucggaagcgugcaguucuccacagacaccgaaaacgauuuugagacccaucaaaauacaaaguucacccccgucggcgugauccaggacggcucuacaacgcaccgcaacgaaccccagcaauggguucugccuagcuacuccgggagaaaugugcacaacguccaucuugccccggcuguggcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguugcccugcuucgcuuugucaaccccgacaccggaagagugcuguucgaguguaaacuccauaagagcggcuaugugacagucgcucacaccgggcagcacgaucuggugauuccgccuaacggcuacuuucgguucgacucuuggguuaaucaguucuauacgcuugcccccaugggaaacggcaccgggagacgccgguga

SEQ ID NO: 29461 - RNA, 1617 nt, Artificial Sequence
  derived and/or modified sequence opt5 from VP1__Norovirus_and/or_Norovirus-like__HM802527
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucuccggcagcagaaauuacaccaugaaccucgcuucucugaauuggaacaauuaugacccuaccgaagagauucccgcgccucuugggacacccgauuucgugggaaaaauccagggcguccugacgcagaccacaaagggggacggauccacccggggccacaaggccacaguguacaccgggagcgcuccguuuacgccuaaacucggauccguucaguucucuacagacaccgaaaacgauuuugagacccaucaaaauacaaaguucacccccgugggcgucacacaggacggcagcacgacccaccgcaacgaaccccagcaaugggugcugccuuccuacagcgggagaaauguucacaacgugcaucuugccccggccgucgcucccacauuuccuggagagcagcuccuguucuuucggucuaccaugcccggcuguuccggguauccuaauauggaucuggacugccugcucccccaggagugggugcagcacuucuaccaagaagccgcgccugcucagagcgauguggcccugcuucgcuuuguuaaccccgacacaggaagaguccuguucgaguguaaacuccauaagucuggcuaugugaccguggcccacacggggcagcacgaucuggucauuccgccuaacggcuacuuucgguucgacagcugggugaaucaguucuauacccuugcucccaugggaaacggcacagggagacgccgguga

SEQ ID NO: 29462 - RNA, 1617 nt, Artificial Sequence
  derived and/or modified sequence opt5 from VP1__Norovirus_and/or_Norovirus-like__GQ856448
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagagauguucacaaugugcaucuugccccggcugucgcccccaccuuuccuggagagcagcuccuguucuuucggagcacaaugcccggcuguucuggguauccuaacauggaccuggauugccugcucccccaggagugggugcagcacuucuaccaagaagcggcuccugcccaguccgacguggcccugcuucgcuuuguuaaucccgauaccggaagaguccuguucgaguguaaacuccauaagagcggcuaugugacaguggcucacaccgggcagcacgaccuggucaucccgccuaacggcuacuuucgguucgauucuugggugaaccaguucuauacgcuugcccccaugggaaauggcaccgggagacgccgguga

SEQ ID NO: 29463 - RNA, 1617 nt, Artificial Sequence
  derived and/or modified sequence opt5 from VP1__Norovirus_and/or_Norovirus-like__AB541347
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagagacuacaccaugaaucucgcgagccugaacuggaauaacuaugauccuaccgaagagauucccgccccucuugggacacccgacuucgugggaaaaauccagggcguccugacgcagaccacaaagggggacggaucuacccggggccacaaggcuacaguguacaccggguccguuccguuuacgccuaaacucggaagcgugcaguucuccacagauaccgaaaaugacuuugagacccaucaaaacacaaaguucacccccgucggcgugauucaggauggcucuacaacgcaccgcaaugaaccccagcaauggguucugccuagcuacuccgggagaaacgugcacaauguccaucuugccccggccguggcucccaccuuuccuggagagcagcuccuguucuuucggagcacaaugcccggcuguucuggguauccuaacauggaccuggauugccugcucccccaggagugggugcagcacuucuaccaagaagccgcgccugcucaguccgacguugcccugcuucgcuuugucaaucccgauaccggaagagugcuguucgaguguaaacuccauaagagcggcuaugugacagucgcccacaccgggcagcacgaccuggugaucccgccuaacggcuacuuucgguucgauucuuggguuaaccaguucuauacgcuugcucccaugggaaauggcaccgggagacgccgguga

SEQ ID NO: 29464 - RNA, 1617 nt, Artificial Sequence
  derived and/or modified sequence opt5 from VP1__Norovirus_and/or_Norovirus-like__AB541298
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucaccccgcccacggucgagucucgcaccaaaccuuucacagugcccauccugaccguugaagagaugacaaacuccagauuuccuauuccccuugagaagcuguucaccgggccgagcggagccuucgugguccagccucagaauggccgguguacgacagacggggugcuccugggaaccacacagcugucucccguuaacaucugcaccuuucgcggcgaugugacccauaucgcuggcuccagaaauuacacaaugaaccucgcgagccugaauuggaacaauuaugacccuacggaagagauucccgccccucuugggacccccgauuucgucggaaaaauccaaggcgugcugacacagaccacaaagggggacggaucuacccggggccacaaggcuacggucuacacaggguccgccccguuuaccccuaaacucggaagcgugcaguucuccaccgacacagaaaacgauuuugaggcccaucagaauaccaaguucacacccguuggcgugauucaagacggcucuacgacccaccgcaacgaaccccagcaguggguccugccuagcuacuccgggagaaaugugcaaaacguucaccuugcuccggccguggcgcccacauuuccuggagagcagcuucucuucuuucggagcaccaugcccggcuguucuggguauccuaauauggaucuggacugccugcucccccaggaguggguccagcauuucuaccaagaagcugccccugcccaguccgaucuggcucugcugcgcuuugugaaccccgacacaggaagaguucucuucgaguguaaacugcacaagagcggcuaugugaccgucgcccauacggggcagcacgaucuugugaucccgccuaacggcuacuuucgguucgacucuugggugaaucaguucuauacccuggcucccaugggaaacggcacagggagacgccgguga

SEQ ID NO: 29465 - RNA, 1617 nt, Artificial Sequence
  derived and/or modified sequence opt5 from VP1__Norovirus_and/or_Norovirus-like__AB541270
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuaugugacaguggcucacaccgggcaguacgaucuggucaucccgccuaacggcuauuuucgguucgacucuugggugaaucaguucuacacgcuugcccccaugggaaacggcaccgggagacgccgguga

SEQ ID NO: 29466 - RNA, 1617 nt, Artificial Sequence
  derived and/or modified sequence opt5 from VP1__Norovirus_and/or_Norovirus-like__AB541263
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacgucugcaccuuucgcggagaugugacacauaucgcuggcagcagaaauuacaccaugaaccucgcgucucugaauuggaacaauuaugacccuaccgaagagauccccgccccucuuggcacacccgauuucgucgggaaaauucagggagugcugacgcagaccacaaagggcgacggguccacccggggacacaaggcuacaguuuacaccggcagcgccccguuuacgccuaaacucggguccgugcaguucucuacagacaccgaaaacgauuuugagacccaucaaaauacaaaguucacccccgucggagugauccaggacggcggcacaacgcaccgcaacgaaccccagcaauggguucugccuagcuacuccgggagagaugugccgaauguccaccuugcccccgcuguggccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguugcccugcuucgcuuugucaauccggauaccggaagagugcuguucgaguguaaacuccacaagagcggcuaugugacagucgcucauaccgggcagcacgaccuggugauuccucccaacggcuacuuucgguucgauucuuggguuaaccaguucuauacgcuugccccuaugggaaauggcaccgggagacgccgguga

SEQ ID NO: 29467 - RNA, 1617 nt, Artificial Sequence
  derived and/or modified sequence opt5 from VP1__Norovirus_and/or_Norovirus-like__AB541256
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcggcccugaauuggaacaauuaugacccuaccgaagagauucccgcuccucuugggacacccgauuucgugggaaaaauccagggcguccugacgcagaccacaaagggggacggaagcacccggggccacaaggccacaguguacaccgggucugccgacuuuacgccgaaacucggauccguucaguucagcacagauaccgaaaacgacuuugagacccaucaaaauacaaaguucaccccugugggcgucauucaggauggcuccacaacgcaccgcaacgaaccccagcaaugggugcugcccucuuacagcgggagaaauguucacaacgugcaucuugcuccugccgucgcgccgaccuuucccggagagcagcuccuguucuuucgguccacaaugccuggcuguagcggguaucccaauauggaccuggauugccugaucccucaggagugggugcagcacuucuaccaagaagcugcccccgcccagucugacguggcucuccugcgcuuuguuaacccugauaccggaagaguccuuuucgaguguaaacugcauaaguccggcuaugugacaguggcccacaccgggcagcacgaccucgucauucccccgaacggcuacuuucgguucgauagcugggugaaucaguucuauacgcuggcuccuaugggaaacggcgccgggagacgccgguga

SEQ ID NO: 29468 - RNA, 1617 nt, Artificial Sequence
  derived and/or modified sequence opt5 from VP1__Norovirus_and/or_Norovirus-like__AB541240
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccuccgagauucuguggucugccccucuuggaccggaucugaaucccuaccucagccaccuggcucgcauguauaacggcuacgccgggggauucgaaguccaggugauccuugcuggcaaugccuuuacagcgggcaaaauuaucuucgccgcuguuccucccaacuuuccuacggaggggcugucccccucucaggugaccauguucccgcauaucauugucgacgugagacaacucgagccugugcugaucccccugccugauguccggaauaacuuuuaucacuacaaucagagcaacgacuccacaauuaagcucaucgccaugcuguauacaccccuucgcgcuaacaaugccggagaagauguuuucaccgugagcugcagagugcugacccggcccucuccugacuuugauuucauuuuucucgucccgcccacaguggagucccgcaccaaaccuuucacgguucccauccugaccguggaagagaugacaaacagcagauuuccuauuccccuugagaagcuguucaccggcccgucuuccgccuucgucgugcagccucagaaugggcgguguacaaccgacggaguucuccugggcacgacacaacugagccccgugaacaucugcaccuuucgcggggaugucacacauaucgcuggaucuagaaauuacaccaugaaccucgcguccauuaauuggaacaauuaugacccuaccgaagagauccccgccccucugggcacacccgauuucgugggcaaaauucaggggguccuuacgcagaccacaaagggagacggcagcacccgggggcacaaggcuacaguguacaccggauccgccccguuuacgccuaaacugggcucuguucaguucagcacagacaccgaaaacgauuuugagacccaucaaaauacaaaguucacccccgugggggucauccaggacggaggcacaacgcaccagaacgaaccccaacagugggugcucccuggcuacuccgggcgcaauguuccgaacgugcaccuggcccccgcugucgccccuaccuuucccggagagcagcuucuguucuuuagaagcacaaugccuggcuguucuggguaucccaauauggaucucgacugccugcugccucaggagugggugcaacauuucuaccaggaagcggcucccgcccaguccgauguggcccuccugcgguuuguuaacccggacaccggacgcguccuuuucgaguguaaacugcacaagagcggcuaugugacaguggcucauaccgggcagcacgaucucgucauuccucccaacggcuacuuuagauucgacucuugggugaaucaauucuauacgcuggccccuaugggaaacggcaccgggcggagacgcuga

SEQ ID NO: 29469 - RNA, 1617 nt, Artificial Sequence
  derived and/or modified sequence opt5 from VP1__Norovirus_and/or_Norovirus-like__AB541233
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacauggaucuggacugccugcucccucaggagugggugcagcauuucuaccaagaagcggcucccgcccagagcgauguggcccugcuucgcuuuguuaauccggacaccggaagaguccuguucgaguguaaacuccacaaggcuggcuaugugacaguggcccauaccgggcagcacgaucuggucaucccucccaacggcuacuuucgguucgacucuugggugaaccaguucuauacgcuugcuccuaugggaaauggcaccgggagacgccgguga

SEQ ID NO: 29470 - RNA, 1617 nt, Artificial Sequence
  derived and/or modified sequence opt5 from VP1__Norovirus_and/or_Norovirus-like__AB541215
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauuccuugguccgaaccgcugggccccgaucuuaauccuuaccugucucaccucgcccgcauguauaacggguacgcuggaggcuucgagguccaggugauccuggccggcaaugcuuuuacagccgggaaaauuaucuucgcggccguucccccuaacuuucccacggagggacuuagcccgucccaggugaccauguucccucauaucauugucgacgugagacaacuggaacccgugcucaucccucugcccgauguccggaauaacuuuuaucacuacaaucagucuaacgacagcacaauuaagcugaucgcuaugcucuauacaccccugcgcgccaacaaugcuggcgaggauguuuucaccguguccugcagagugcuuacccggccuagcccggacuuugauuucauuuuucuggugcccccuacagucgaaucucgcaccaaacccuucacgguuccuauccucaccguggaggagaugacaaacuccagauuucccauuccgcuggaaaaacuuuucaccgggccuagcucugccuucgucgugcagccccagaauggacgguguacaaccgacggcguucugcucgggacgacacaacuguccccugugaacaucugcaccuuucgcggagaugucacacauaucgccggcagcagaaauuacaccaugaaccuggcuucucucaauuggaacaauuaugaccccaccgaggaaauuccugcgccccugggcacaccggauuucguggggaagauccagggaguccuuacgcagaccacaaagggcgacggguccacccggggacacaaggccacaguguacaccggcagcgcugacuuuacgccuaaacugggguccguucaguucucuacagauaccgagaacgacuuugaaacccaucaaaauacaaaguucacccccgugggagucauucaggauggcggcacaacgcaccgcaacgagccccagcaaugggugcucccuagcuacuccgggagaaauguucacaacgugcaucuggccccggccgucgcucccaccuuuccuggagagcagcuucuguucuuucggagcacaaugcccggcuguucuggguauccuaauauggaccucgauugccugcugccccaggaaugggugcagcacuucuaccaagaggccgcgccugcucaguccgacguggcccuccugcgcuuuguuaaccccgauaccggaagaguccuuuucgaauguaaacugcauaagagcggcuaugugacaguggcccacaccgggcagcacgaccucgucaucccgccuaacggcuacuuucgguucgauucuugggugaaucaguucuauacgcuggcucccaugggaaacggcaccgggagacgccgguga

SEQ ID NO: 29471 - RNA, 1617 nt, Artificial Sequence
  derived and/or modified sequence opt5 from VP1__Norovirus_and/or_Norovirus-like__AB541201
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuagcgacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugagacccaucaaaacacaaaguucacccccgugggcgucauucaggacggcagcacaacgcaccgcaaugaaccccagcaaugggugcugccuuccuacagcgggagaaacguucacaaugugcaucuugccccggcugucgcccccaccuuuccuggagagcagcuccuguucuuucggucuacaaugcccggcuguuccggguauccuaacauggaucuggacugccugcucccccaggagugggugcagcacuucuaccaagaagcggcuccugcccagagcgauguggcccugcuucgcuuuguuaaucccgacaccggaagaguccuguucgaguguaaacuccauaagucuggcuaugugacaguggcucacaccgggcagcacgaucuggucaucccgccuaacggcuacuuucgguucgacagcugggugaaccaguucuauacgcuugcccccaugggaaauggcaccgggagacgccgguga

SEQ ID NO: 29472 - RNA, 1617 nt, Artificial Sequence
  derived and/or modified sequence opt5 from VP1__Norovirus_and/or_Norovirus-like__FJ411172
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggucuaacuacgauccuacagaggaaauucccgccccucugggcacgcccgacuuuguggggaagauccagggaaugcuuacccagacaacccgcagagacggcuccacacgggggcacaaagcuaccguccugacgggaagcgccgauuucgccccgaagcucggccgcgugcaauuugcuacagacaccgauaaugacuucgaguccggggaaaacaccaaguuuacaccuguuggagugauucaggauggcucuaccacacauagaaaugagccccagcaauggguccugcccaacuacagcggccggacggggcacaaugugcaccuugccccugcgguugcuccgaccuaucccggagaacagcuccuguucuuuagauccacaaugccuggcuguagcggguaccccaacauggaccuggauugccugcucccucaggagugggugcgccauuucuaucaggaggccgcccccgcucaaucugacgucgcccugcuucgguuugugaauccugauaccggaagagugcuguucgaauguaaacuccacaaguccggcuacguuacagucgcucauaccgggcagcacgaccuggugauucccccgaacggcuauuuucgcuucgauagcugggugaaccaguuuuacacgcuugccccuaugggaaauggcgcggggcggagacgcuga

SEQ ID NO: 29473 - RNA, 1617 nt, Artificial Sequence
  derived and/or modified sequence opt5 from VP1__Norovirus_and/or_Norovirus-like__AB447449
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagagacuacaccaugaaucucgcgagccugaacuggaauaacuaugauccuaccgaagagauucccgccccucuugggacacccgacuucgugggaaaaauccagggcguccugacgcagaccacaaagggggacggaucuacccggggccacaaggcuacaguguacaccggguccgccccguuuacgccuaaacucggaagcguucaguucuccacagauaccgaaaaugacuuugagacccaucaaaacacaaaguucacccccgugggcgucauucaggauggcucuacaacgcaccgcaaugaaccccagcaaugggugcugccuagcuacuccgggagaaacguucacaaugugcaucuugccccggcugucgcccccaccuuuccuggagagcagcuccuguucuuucggagcacaaugcccggcuguucuggguauccuaacauggaccuggauugccugcucccccaggagugggugcagcacuucuaccaagaagcggcuccugcccaguccgacguggcccugcuucgcuuuguuaaucccgauaccggaagaguccuguucgaguguaaacuccauaagagcggcuaugugacaguggcucacaccgggcagcacgaccuggucaucccgccuaacggcuacuuucgguucgauucuugggugaaccauuucuauacgcuugcccccaugggaaauggcaccgggagacgccgguga

SEQ ID NO: 29474 - RNA, 1617 nt, Artificial Sequence
  derived and/or modified sequence opt5 from VP1__Norovirus_and/or_Norovirus-like__AB447431
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaaugaccaacuccagauuuccuauuccccuugagaagcuguucacagggccgagcucugccuucgucgugcagccucagaauggacgguguaccacggauggcguucuccuggggacaacccaacugucccccgugaacaucugcacauuucgcggagacgucacccauaucgccggcagcagaaauuacaccaugaaccucgcuucucugaauuggaacaauuaugauccuacagaggaaauucccgcgccucuuggcacgcccgacuucguggggaaaauccagggaguccugacccagacaaccaagggcgacggguccacacggggacacaaggccaccguguacacgggcagcgcuccguuuacaccuaaacucggguccguucaguucucuaccgauaccgagaacgacuuugaaacacaucaaaauaccaaguucacacccgugggagucauucaggauggcggcacgacccaccgcaacgagccccagcaaugggugcugccuagcuacuccgggagaaauguucacaacgugcaucuugccccggccgucgcucccacauuuccuggagaacagcuccuguucuuucggagcaccaugcccggcuguucuggguauccuaauauggaccuggauugccugcucccccaggagugggugcagcacuucuaccaagaggccgcgccugcucaguccgacguggcccugcuucgcuuuguuaaccccgauacaggaagaguccuguucgaauguaaacuccauaagagcggcuaugugaccguggccuacacggggcagcacgaccuggucaucccgccuaacggcuauuuucgguucgauucuugggugaaucaguucuacacccuugcucccaugggaaacggcacagggagacgccgguga

SEQ ID NO: 29475 - RNA, 1617 nt, Artificial Sequence
  derived and/or modified sequence opt5 from VP1__Norovirus_and/or_Norovirus-like__EU078415
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuucuagcuccuucgucgugcagccccagaacggacgguguaccacggauggcguucuccuggggacaacccaacugagcccugugaauaucugcacauuucgcggagacgucacccauaucgccggcacccagaacuacacaaugaaucucgccucucagaacuggaauaacuaugaucccacggaggaaauuccugcuccccugggcaccccggacuucguggggaaaauccagggaguccuuacacaaaccacaagaggcgacggguccacccggggacacaaggcgacggugagcacaggcuccguucauuuuaccccuaagcuggggucugugcaguucagcaccgauacauccaaugacuuugagaccggacagaacacacgcuucacgcccgucggcgugguucaagauggcagcaccacacaccagaaugaaccccagcagugggugcucccugacuacucugggagaaacucccacaauguccaucuggccccggcuguggcccccaccuuuccuggagagcaacuucuguucuuucggagcacaaugcccggcuguucuggguacccuaacaugaaucucgauugccugcugccccaggaaugggugcagcacuucuaucaggagagcgccccugcucaauccgacguugcccuccugcgcuuugucaaccccgauaccggaagagugcuuuucgaguguaaacugcauaagucuggcuacgugacggucgcgcacaccgggcagcacgaccucgugauuccgccuaacggcuauuuucgguucgauagcuggguuaaucaguucuacacacuggcucccaugggaaacggcgccgggagacgccgguga

SEQ ID NO: 29476 - RNA, 1617 nt, Artificial Sequence
  derived and/or modified sequence opt5 from VP1__Norovirus_and/or_Norovirus-like__AB385643
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaugaucgucgacgugagacaacucgagccugugcugauuccccugccugauguccggaacaauuuuuaucacuacaaccagagcaaugaccccaccaucaagcucauugcuaugcuguauacaccccuucgcgccaacaacgcuggcgaugacguuuucaccguguccugcagagugcugacacggccuagcccggauuuugacuucaucuuucucgugcccccuaccgucgaaucucgcacgaaacccuucuccguuccuauucugaccguggaggaaaugacaaauagcagauuucccaucccgcuugagaagcuguucaccgggccuucuuccgccuucgucgugcagccccagaacggacgguguacaaccgauggcguucuccuggggacgacacaacugagcccugugaauauuugcaccuuucgcggagacgucacacauaucgccggcacccaggaguacaccaugaaccucgcuucucagaauuggaacaauuaugaucccacagaagagaucccugcgccccugggcacgccggacuucguggggaaaauucagggaguccuuacccaaacaaccagaggcgacggguccacacggggacacaaggccaccgugagcacgggcuccguucauuuuacaccuaagcuggggcgcauccaguucucuaccgauaccagcaacgacuuugaaacaggacagaauaccagauucacacccgugggcgucgugcaagauggcuccacgacccaccagaacgagccccagcaguggguucucccuaauuacagcgggcgggacucucacaacgugcaucuggcuccggccgucgcccccuccuuuccuggagaacaacuucuguucuuucgcagcacaaugcccggcuguucuggguacccuaauaugaaccucgauugccugcugccccaggagugggugcagcacuucuaucaggaggcugccccugcgcaaagcgacguggcucuccugagauuuguuaaucccgauaccggacggguccuuuucgaauguaaacugcauaaguccggcuacgugacaguggcccacaccgggcagcacgaccucgucauuccgccuaacggcuauuuuagauucgauucuugggugaaccaguucuacacgcuggcccccaugggaaauggcaccgggcgccggagauga

SEQ ID NO: 29477 - RNA, 1617 nt, Artificial Sequence
  derived and/or modified sequence opt5 from VP1__Norovirus_and/or_Norovirus-like__AB385636
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgauagcugcagagugcugacccggccuuccccggacuuugauuucauuuuucucgugcccccuacggucgaaagccgcaccaaacccuucucugugccuauccugacaguugaggaaaugaccaauuccagauuucccauuccgcuugagaagcuguucacagggccuagcucugccuucgugguccagccccagaacggacgguguaccacggacggcgugcuccuggggacaacccaacuguccccuguuaauaucugcacauuucgcggagaugugacccauaucgccggcacccagaacuacacaaugaaucucgcuagccagaacuggaauaacuaugaccccacggaggaaauuccugcgccccugggcaccccggacuucgucgggaaaauccagggagugcuuacacaaaccacaagaggcgaugggucuacccggggacacaaggccacggucuccacaggcagcgugcauuuuaccccuaagcugggguccguucaguucucuaccgacacaagcaaugaucucgagaccggacagaacacacgcuuuacgcccgugggcgucgugcaagacggcuccaccacacaccagaaugaaccccagcaguggguucugccuaacuacagcgggagagauucucacaaugugcaucuugcuccggccgucgcccccaccuucccuggagagcaacugcucuuuuuccgguccacaaugcccggcuguagcggguacccuaacaugaaucuggacugccugcucccccaggaaugggugcagcacuuuuaucaggagucugcuccugcccaaagcgauguggcgcugcuucgcuucguuaaccccgacaccggaagaguccuguuugaguguaaacuccauaaguccggcuacgugacgguggcucacaccgggcagcacgaucuggucauuccgccuaacggcuauuuccgguuugacucuugggugaaucaguucuacacacuugcccccaugggaaacggcgccgggagacgccgguga

SEQ ID NO: 29478 - RNA, 1617 nt, Artificial Sequence
  derived and/or modified sequence opt5 from VP1__Norovirus_and/or_Norovirus-like__AB385629
augaagauggccagcaacgacgcuacccccuccgauggcucuacagccaaucuggugccugaggucaacaaugaaguuauggcgcucgagccgguggcuggggccgccaucgcugcccccguggcuggacagcaaaacgucauugacccuuggaucagaaauaacuucgugcaggcccccggcggggaauuuacgguuagcccucggaaugcgcccggagagauucugugguccgccccucuuggcccggaucugaaccccuaccucucucaccuggcucgcauguauaauggguacgccggaggcuucgaagugcaggucauccuugcuggcaacgccuuuaccgcggggaaaauuaucuucgccgcugugccucccaauuuuccuacagagggacugagccccucccagguuaccauguucccgcauaucauuguggacgucagacaacucgagccugugcugaucccccugccugaugugcggaacaauuuuuaucacuacaaccagucuaaugaccccacaauuaagcucaucgccaugcuguauacaccccuucgcgcuaacaacgccggcgaugacgucuucaccguuagcugcagagugcugacccggccuuccccggauuuugacuucauuuuucucgugcccccuacggucgaaagccgcaccaaacccuucucugugccuauccugacaguugaggaaaugaccaauuccagauuucccauuccgcuugagaagcuguucacagggccuagcucugccuucgugguccagccccagaacggacgguguaccacggauggcgugcuccuggggacaacccaacuguccccuguuaauaucugcacauuucgcggagacgugacccauaucgcuaacacccagaauuacacaaugaaccucgcgagccagaauuggaacaauuaugaucccacggaggaaauuccugcuccccugggcaccccggacuucgucggcagaauccagggggugcuuacacaaaccacacggggagacggcucuacccgcgggcacaaagccacggucuccacaggaagcgugcauuuuaccccuaagcugggcuccguucaguucucuaccgauacaagcaacgaccucgagaccgggcagaauacaagauuuacgcccgugggagucgugcaagauggcggcaccacacaccggaacgaaccccagcaguggguucugccugacuacuccgggcgcgauagccacaaugugcaucuugccccggccgucgcucccaccuucccuggagagcagcugcucuuuuucagaucuacaaugcccggcuguuccggguacccuaacaugaaucuggacugccugcucccccaagaaugggugcagcacuuuuaucaggagagcgccccugcgcagucugauguggcucugcuucgguucguuaaccccgacaccggaagaguccuguuugaguguaagcuccauaaaagcggcuacgugacgguggcccacaccgggcaacacgaucuggucauuccgccuaacggcuauuuccgcuuugacuccugggugaaucaguucuacacacuugcccccaugggaaacggcgcugggcggagacgcuga

SEQ ID NO: 29479 - RNA, 1617 nt, Artificial Sequence
  derived and/or modified sequence opt5 from VP1__Norovirus_and/or_Norovirus-like__EU839586
augaagauggccagcaacgacgcuucccccucugauggcagcaccgccaaucuggugccugaggucaacaaugaaguuauggcgcucgagccgguggugggggcugccaucgccgcucccgucacaggacagcaaaacgugauugacccuuggaucagaaauaacuucguucaggcccccggcggggaauuuacgguguccccucggaaugcucccggagagauucuguggucugccccucuuggcccggaucugaaccccuaccucagccaccuggcgcgcauguauaauggguacgccggaggcuucgaaguccaggugauccuugcuggcaacgccuuuaccgcugggaaaauuaucuucgccgcgguuccucccaauuuuccuacagagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacgguggaaucccgcaccaaaccuuucacaguucccauccugaccguggaggaaaugacaaauagcagauuuccuauuccccuugagaagcuguucaccgggccgucuuccgcuuucgucgugcagccucagaacggacgguguacgacagauggcguucuccuggggaccacacaacugagccccgugaauaucugcaccuuucgcggagacgucacccauaucccuggcacaagaacguaccggaugaaccucgccucucagaauuggaacaauuaugaucccaccgaggaaauuccugcuccccugggcacaccggacuucguggggaaaauccagggaaugcuuacccagacaaccaagggcgacggguccacgcgcggacacaaggccacagucagcaccggcuccguggauuuuaccccuaaacuggggucuguucaauucgcgacagacaccgauaacgacuuugagacaggacagaauacgagauucacccccgugggcgucauucaggauggcagcuccacacaucggaacgaaccccaacagugggugcucccugacuacagcgggcgcaccgcccacaauguucaccuggcuccggccguggcccccacauuuccuggagagcagcuucuguucuuuagaucuaccaugcccggcuguuccggguacccuaacauggaucucgacugccugcugccccaggaauggguccaacauuucuaucaggaggcugccccuagccagucugauguggcgcuccugcgguuugugaaucccgacacgggaagaguucuuuucgaguguaagcugcacaaagcuggcuacgucaccguggcccauacagggcagcacgaucucgugaucccgccuaacggcuauuuucgcuucgacagcugggucaaucaauucuacacccuggcccccaugggaaacggcgcugggcggagacgcuga

SEQ ID NO: 29480 - RNA, 1617 nt, Artificial Sequence
  derived and/or modified sequence opt5 from VP1__Norovirus_and/or_Norovirus-like__EU310927
augaagauggccagcuccgacgcuucucccagcgauggcuccaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucaccguuccuauccugacaguggaggaaaugaccaacagcagauuucccauuccgcuugagaagcuguucacagggccuucuggagccuucgucgugcagccccagaauggccgguguaccacggaugggguucuccugggaacaacccaacuguccccugugaacaucugcacauuucgcggcgacgucacccauaucgccggcacccacgauuacacaaugaaucucgcuagccagaacuggaauaacuaugaccccacggaggaaauuccugcgccccuggggaccccggacuucgugggaaaaauccagggcguccuuacacagaccacaagaggggauggaucuacccggggccauaaggccacgguguccacagggagcguucacuuuaccccuaagcugggauccgugcaauucaccacagacaccaauaacgaucucgagacaggccagaauacgaaauuuacccccgucggcgugguucaggacgggaacucugcucaccaaaaugaaccccagcagugggugcugccuaacuacagcggacgcacaggccauaauguccaccuugccccggccguggcucccaccuucccuggggagcagcugcucuuuuucagauccacaaugcccggauguagcggcuacccuaacaugaaucuggauugccugcucccccaagaaugggugcugcauuuuuaucaggaggccgcgccugcucagucugacguugcccuucugcgguucgucaaccccgauaccgggcgcgugcucuuugaguguaagcugcacaaauccggcuacgugacggucgcccacaccggaccgcaugaccuugugauuccucccaacggcuauuucagauuugauagcuggguuaaucaguucuacacacuggcuccuauggggaacggagccggccggagacgcuga

SEQ ID NO: 29481 - RNA, 1617 nt, Artificial Sequence
  derived and/or modified sequence opt5 from VP1__Norovirus_and/or_Norovirus-like__AB294787
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucacgguucccauccugaccguggaggaaaugacaaauagcagauuuccuauuccccuugagaagcuguucaccgggccgucuuccgccuucgucgugcagccucagaacggacgguguacaaccgauggcguucuccuggggacgacacaacugagccccgugaauaucugcaccuuucgcggagacgucacacauaucucuggcaccagaaccuaccggaugaaccucgcuucccagaauuggaacaauuaugauccuacagaggaaauucccgcgccucugggcacgcccgacuucguggggaaaauccagggaaugcuuacccagacaaccaagggcgacgggagcacacgcggacacaaggccaccgucuccacgggcucuguggauuuuacaccgaaacuggggagcguucaauucgcuaccgacaccgauaacgacuuugagacaggacagaauaccagauucacaccugugggcgucauucaggauggcuccagcgcccaucggaacgaaccccaacagugggugcuccccgacuacucugggcgcacgguucacaaugugcaccuggccccugcugucgccccgaccuuucccggagagcagcuucuguucuuuagauccacaaugccuggcuguagcggguaccccaacauggaucucgacugccugcugccucaggaaugggugcaacauuucuaucaggaggcggcucccucucagagcgauguggcccuccugcgguuuguuaauccugacaccggaagaguccuuuucgaguguaagcugcacaaagccggcuacgugacaguggcucauaccgggcagcacgaucucgucauucccccgaacggcuauuuucgcuucgacuccugggugaaucaauucuacacgcuggccccuaugggaaacggcgcugggcggagacgcuga

SEQ ID NO: 29482 - RNA, 1617 nt, Artificial Sequence
  derived and/or modified sequence opt5 from VP1__Norovirus_and/or_Norovirus-like__AY587987
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcgccuuucgcggcgaugucacacauaucgcuggcacccacaauuacaccaugaaccucgcgucucagaauuggaacaauuaugaccccacagaagagauuccugcuccccuggggacgccggauuucgugggaagaauccagggcaugcuuacccagacaacccgcggggacggauccacacggggccauaaagccaccgucagcacgggggacgugcacuuuacaccuaagcugggaucuauucaauucaacaccgauaccaauaacgacuuugaaacaggccagaauaccaaguucacacccguuggcgugguccaggaugggaacggaacgcaccaaaaugagccccagcagugggugcucccuuccuacagcggcagaaccgggcauaacguucaccuggccccggccguggcucccacauuuccuggagaacagcuucuguucuuucgguccaccaugcccggcuguucuggguacccuaacaugaaucucgacugccugcugccccaagaguggguccagcauuucuaucaggaggccgcgccugcucagagcgauguggcccuccugcgcuuugugaaccccgacacaggcagaguucuuuucgaauguaaacugcacaaguccggauacgucaccguggcccacacgggccaacaugaucucgugaucccgccuaauggguauuuucgguucgacagcugggucaaccaguucuacacccuggcucccaugggaaauggcacagggagacgccgguga

SEQ ID NO: 29483 - RNA, 1617 nt, Artificial Sequence
  derived and/or modified sequence opt5 from VP1__Norovirus_and/or_Norovirus-like__AY502019
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuguuuucgcggccgugccucccaacuuuccuaccgagggacugagccccucccaggucacaauguucccgcauaucaucguggacgugagacaacucgagccuguccugauuccccugccugauguucggaauaacuuuuaucacuacaaucagucuaacgaccccaccaucaagcucauugcuaugcuguauacaccccuucgcgccaacaaugcuggcgaagauguguucaccgugagcugcagaguccugacacggccuuccccggacuuugauuucaucuuucucgugcccccuaccguugagagccgcacgaaacccuucaccgugccuauucugacagucgaagagaugaccaacucuagauuucccaucccgcuugagaagcuguucacagggccuuccagcgccuucgugguucagccccagaauggacgguguaccacggacggcgugcuccuggggacaacccaacugucuccugucaacauuugcacauuucgcggagaugugacccauaucgccggcacccacaauuacacaaugaaccucgcuucccagaauuggaacaauuaugaccccacggaagagaucccugcgccccugggcaccccggauuucgucgggcggauucagggaaugcuuacacagaccacaagaggcgacgggagcacccgcggacauaaagccacggugucuacaggcgacguucacuuuaccccuaagcugggguccauccaauucaacaccgauacaaauaacgacuuugaaaccggacagaauacaaaguucacgcccgugggcgucgugcaggauggcaacgggacccaccaaaaugagccccagcaguggguucucccuagcuacuccggaagaacaggccauaacgugcaccuggcuccggccgucgcccccaccuuuccuggggaacagcuucuguucuuucggucuacaaugcccggauguagcggcuacccuaacaugaaucucgacugccugcugccccaagagugggugcagcauuucuaucaggaggcugccccugcgcaguccgauguggcucuccugcgcuuuguuaaccccgacaccgggagaguccuuuucgaauguaaacugcacaagagcggcuacgugacgguggcccacaccggacaacaugaucucgucauuccgccuaauggcuauuuucgguucgacucuugggugaaccaguucuacacacuggcccccauggggaauggaaccggcagacgccgguga

SEQ ID NO: 29484 - RNA, 1617 nt, Artificial Sequence
  derived and/or modified sequence opt5 from VP1__Norovirus_and/or_Norovirus-like__LC177653
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuguuuucgccgcugugccucccaacuuuccuacggagggacugagccccucccaggucaccauguucccgcauaucaucguggacgugagacaacucgagccuguccugauuccccugccugauguucggaauaacuuuuaucacuacaaucagucuaacgacagcacaaucaagcucauugccaugcuguauacaccccuucgcgcuaacaaugccggcgaagauguguucaccguguccugcagaguccugacccggcccagcccugacuuugauuucaucuuucucgugccgcccacaguugagucucgcaccaaaccuuucacggugcccauucugaccgucgaagagaugacaaacuccagauuuccuaucccccuugagaagcuguucaccgggccgagcggagccuucauugugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugaggcccaucaaaauaccaaguucacacccgugggcgucauucaggacggcgggaccacacaccgcaacgaaccccagcaaugggugcugccuucuuacagcggaagagauguucacaaugugcaucuugcuccggccgucgcgcccacguuuccuggcgagcagcuccuguucuuucgguccaccaugcccggguguagcggauauccuaacauggaccuggauugccugcucccccaggagugggugcagcacuucuaccaagaagcugccccugcccagucugacguggcucugcuucgcuuuguuaaucccgauacaggcagaguccuguucgaguguaaacuccauaaguccggguaugugaccguggcccacacaggccagcacgaccuggucaucccgccuaacggauacuuucgguucgauagcugggugaaccaguucuauacccuugcucccaugggcaaugggacgggaagacgccgguga

SEQ ID NO: 29485 - RNA, 1617 nt, Artificial Sequence
  derived and/or modified sequence opt5 from VP1__Norovirus_and/or_Norovirus-like__AB972486
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucgccacagacaccgaaaacgauuuugagacccaucaaaauacaaaguucacccccguuggagugauucaggacggcggcacaacgcaccgcaacgaaccccagcaauggguccugccuucuuacagcgggagaaaugugccgaacguucaccuugcucccgccguggcgccuaccuuucccggagagcagcuccuguucuuucgguccacaaugccuggcuguagcggguaucccaauauggaucuggacugccugcucccucaggaguggguccagcauuucuaccaagaagcugcccccgcccagucugauguggcucugcuucgcuuugugaacccggacaccggaagaguucuguucgaguguaaacuccacaaguccggcuaugucacaguggcccauaccgggcagcacgaucuggugaucccucccaacggcuacuuucgguucgacagcugggucaaucaguucuauacgcuugcuccuaugggaaacggcaccgggagacgccgguga

SEQ ID NO: 29486 - RNA, 1617 nt, Artificial Sequence
  derived and/or modified sequence opt5 from VP1__Norovirus_and/or_Norovirus-like__KR904235
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucuacgccucuuggcccggaucugaaccccuaccucagccaccuggcgcgcauguauaauggguacgccggaggcuucgaaguccaggugauccuugcuggcaacgccuuuaccgcugggaaaauuaucuucgccgcgguuccucccaauuuuccuacagagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacggucgaaucucgcaccaaacccuucuccguuccugugcugacagucgaggaaaugaccaauagcagauuucccaucccgcuugagaagcuguucacagggccuucuuccgcuuucgugguucagccccagaacggacgguguaccacggauggcgugcuccuggggacaacccaacugagcccugucaauauuugcacauuucgcggagacgugacccauaucucuggcuccagaaacuacaccaugaaucucgccagccagaacuggaacuccuaugaucccacagaggaaaucccugcuccccugggcacgccggacuucgucgggaaaauucagggagugcuuacccagacaacccggacagacggcucuacccgcgggcacaaggccacgguuuacacaggaagcgcggauuuuuccccuaagcugggcagagugcaauucgccaccgacaccgauaaugacuuugagacaaaucagaacaccaaauucacacccgucggggugauccaggauggaagcacgacccaucggaaugaaccccaacaguggguucucccuucuuacuccggccgcaacacacacaaugugcaccuggcuccggccgucgcccccaccuuuccuggcgagcagcuucuguucuuuagaagcacaaugcccggguguucuggauauccuaacauggaccucgauugccugcugccccaggaaugggugcaauacuucuaucaggaggcugccccugcgcagagcgacguggcucuccugcgguuuguuaaucccgauaccggcagaguccuuuucgaguguaagcugcauaaauccggguacgugacgguggcccacaccggacagcaugaccucgucauuccgccuaacggcuauuuucgcuucgauucuugggugaaccaauucuacacacuggcccccauggggaauggcaccggacggagacgcuga

SEQ ID NO: 29487 - RNA, 1617 nt, Artificial Sequence
  derived and/or modified sequence opt5 from VP1__Norovirus_and/or_Norovirus-like__AB933753
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccacauucgucgugcagccccagaacggacgguguaccacggauggcguucuccuggggacaacccaacugagcccugugaauaucugcacauuucgcggagacgucacccauaucgccggcucuagaaacuacaccaugaaucucgccucccagaacuggaauagcuaugaucccacagaggaaauuccugcuccccugggcacgccggacuucguggggaaaauccagggaguccuuacccagacaacccggacagacggcuccacccgcgggcacaaggcgacgguguacacaggaucugccgauuuuagcccuaagcugggcagaguucaauucgcuaccgacaccgauaacgacuuugaugccaaucagaacacaaaauucacccccgugggggucauucaggacggaggcacagcccaucggaaugagccccaacagugggugcucccuuccuacagcggccgcaacacgcacaauguucaccuggcuccggccguggcgcccaccuuuccuggggaacagcuucuguucuuuagaucuacaaugcccggauguuccggcuauccuaacauggaucucgacugccugcugccccaggaguggguccaauacuucuaucaggaagcugccccugcccagagcgauguggcucuccugcgguuugugaaucccgacaccgggagaguucuuuucgaguguaagcugcauaaaucuggauacgucacaguggcccacaccggccagcaugaucucgugaucccgccuaacggguauuuucgcuucgacagcugggucaaccaauucuacacgcuggcucccaugggcaauggaaccggccggagacgcuga

SEQ ID NO: 29488 - RNA, 1617 nt, Artificial Sequence
  derived and/or modified sequence opt5 from VP1__Norovirus_and/or_Norovirus-like__AB933721
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccgugcugaccgucgaagagaugacaaacuccagauuuccuaucccccuugagaagcuguucaccgggccgagcucugccuucgugguucagccucagaauggacgguguacaaccgacggcgugcuccuggggacgacacaacugucccccgucaacauuugcaccuuucgcggagaugugacacauaucgcuggcagcagaaauuacaccaugaaccucgcgucucugaauuggaacaauuaugacccuaccgaagagauccccgccccucuuggcacacccgauuucgucgggaaaauucagggaaugcugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauccaggacggcagcacaacgcaccgcaacgaaccccagcaaugggugcugccuuccuacagcggcagaaauguuccgaacgugcaccuugcccccgcugucgccccuaccuuucccggggagcagcuccuguucuuucggucuacaaugccuggauguuccggcuaucccaauauggaucuggacugccugcucccucaggagugggugcagcauuucuaccaagaagcggcucccgcccagagcgauguggcccugcuucgcuuuguuaacccggacaccgggagaguccuguucgaguguaaacuccacaagucuggauaugugacaguggcucauaccggccagcacgaucuggucauuccucccaacggguacuuucgguucgacagcugggugaaucaguucuauacgcuugccccuaugggcaacggaaccggcagacgccgguga

SEQ ID NO: 29489 - RNA, 1617 nt, Artificial Sequence
  derived and/or modified sequence opt5 from VP1__Norovirus_and/or_Norovirus-like__AB933706
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggccuccugcuggggacgacacaacucucccccguuaacaucugcaccuuucgcggagaugugacacauaucgcuggcagcagaaauuacaccaugaaccuggcgucucuuaauuggaacaauuaugacccuaccgaagagauucccgccccucugggcacacccgauuucgucgggaaaauccagggaaugcucacgcagaccacaaagggcgacggguccacccggggacacaaggcuacaguguacaccggcagcgccccguuuacgccuaaacugggguccguccaguucucuacagacaccgaaaacgauuuugagacccaucaaaauacaaaguucacccccgugggaguuauucaggacggcagcacaacgcaccgcaacgaaccccagcaaugggugcuuccuuccuacagcggcagaaaugucccgaacgugcaccuggcccccgcuguugccccuaccuuucccggggagcagcuccuguucuuucggucuacaaugccuggauguuccggcuaucccaauauggaucuggacugccuccugccucaggagugggugcagcauuucuaccaagaagcggcucccgcccagagcgaugucgcccuucugcgcuuugugaacccggacaccgggagaguucucuucgaguguaaacugcacaagucuggauaugugacagucgcucauaccggccagcacgaucuugugaucccucccaacggguacuuucgguucgacagcugggugaaucaguucuauacgcuggccccuaugggcaacggaaccggcagacgccgguga

SEQ ID NO: 29490 - RNA, 1617 nt, Artificial Sequence
  derived and/or modified sequence opt5 from VP1__Norovirus_and/or_Norovirus-like__AB933669
augaagauggccagcaacgacgcuaccgccuccgauggcucugcggcuaaucuggugcccgaggucaacaaugaaguuauggcccucgagccuguggugggggccgcuaucgccgcuccggucgccggacagcaaaacgugauugaccccuggaucagaaauaacuucguucaggcgccuggcggggaauuuacagugagcccccggaaugccccuggagagauucugugguccgcuccccuuggcccugaucugaacccguaccucucucaccuggcccgcauguauaauggguacgcuggaggcuucgaaguccaggugauccuugccggcaacgcguuuacggccgggaaaauuaucuucgcugccguucccccuaauuuucccaucgagggacugagcccuucccaggugaccauguucccccauauuaucgucgacgugagacaacucgagccggugcugauuccucugcccgauguccggaacaauuuuuaucacuacaaccagucuaaugacagcacaaucaagcucauugcuaugcuguauaccccucuucgcgccaacaacgccggcgaagauguuuucacaguguccugcagagugcugacccggcccagccccgacuuugauuucaucuuucucgucccuccgacaguggagucucgcaccaaacccuucacgguuccuauucugaccguggaagagaugacaaauuccagauuucccaucccucuugagaagcuguucaccgggcccagcucugcuuucgucgugcagccgcagaacggacgguguacaaccgacggcguucuccuggggacgacacaacuguccccugugaauaucugcaccuuucgcggagaugucacacauauugcgggcagcagaaacuacaccaugaaucucgccucucugaacuggaauaacuaugaccccaccgaagagaucccugcuccccuuggcacaccugauuucguggggaaaauucagggaguccugacgcagaccacaaagggcgacggguccacccggggacacaaggccacaguguacaccggcagcgcccccuuuacgccgaaacucggguccguucaguucucuacagacaccgaaaaugauuuugagacccaucaaaacacaaaguucaccccugugggagucauccaggacggcggcacaacgcaccgcaaugaaccccagcaaugggugcugcccagcuacuccgggagaaacguuccuaaugugcaccuugcuccggccgucgcgcccaccuuuccuggagagcagcuccuguucuuucggagcacaaugcccggcuguucuggguauccuaacauggaucuggacugccugcucccccaggagugggugcagcauuucuaccaagaagcugccccugcccaguccgauguggcucugcuucgcuuuguuaaucccgacaccggaagaguccuguucgaguguaaacuccacaagagcggcuaugugacaguggcccauaccgggcagcacgaucuggucauuccgccuaacggcuacuuucgguucgacucuugggugaaccaguucuauacgcuugcucccaugggaaauggcaccgggagacgccgguga

SEQ ID NO: 29491 - RNA, 1617 nt, Artificial Sequence
  derived and/or modified sequence opt5 from VP1__Norovirus_and/or_Norovirus-like__EU921350
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcacccaggaguacaccaugaaccucgcuucucagaauuggaacaauuaugaucccacagaagagauuccugcgccccugggcacgccggacuucguggggaaaauccagggaguccuuacccaaacaaccagacgggacggcuccacacgcgggcacaaggccaccgugagcacgggauccguucauuuuacaccuaagcugggccggauucaguucucuaccgauaccagcaacgacuuugaaacagggcagaauaccagauucacacccgugggagucgugcaagauggcuccacgacccaccagaacgagccccagcagugggcucucccugacuacagcggccgcgauucucacaauguucaucuggccccggccguggcucccuccuuuccuggggaacaacuucuguucuuuagaagcacaaugcccggauguucuggcuacccuaacaugaaucucgacugccugcugccccaggaguggguccagcacuucuaucaggaggccgcgccugcucaaagcgauguggcccuccugcgguuugugaaccccgacaccgggagaguucuuuucgaauguaaacugcauaaguccggauacgucacaguggcccacaccggccagcacgaucucgugaucccgccuaauggguauuuucgcuucgacucuugggucaaccaguucuacacgcuggcucccaugggcaacggaaccggccggagacgcuga

SEQ ID NO: 29492 - RNA, 1617 nt, Artificial Sequence
  derived and/or modified sequence opt5 from VP1__Norovirus_and/or_Norovirus-like__LC005712
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaauuuacaccggcagcgccccguuuacgccuaaacucggguccgugcaguucucuacagacaccgaaaacgauuuugagacccaucaaaauacaaaguucacccccguuggagugauccaggacggcggcacaacgcaccgcaacgaaccccagcaauggguccugccuagcuacuccgggagagaugugccgaauguucaccuugcccccgcuguggccccuaccuuucccggagagcagcuccuguucuuucggagcacaaugccuggcuguucuggguaucccaacauggaccuggauugccugcucccucaggaguggguccagcauuucuaccaagaagcggcucccgcccaguccgacguggcccugcuucgcuuugugaauccggauaccggaagaguucuguucgaguguaaacuccacaagagcggcuaugucacaguggcucauaccgggcagcacgaccuggugauuccucccaacggcuacuuucgguucgauucuugggucaaccaguucuauacgcuugccccuaugggaaauggcaccgggagacgccgguga

SEQ ID NO: 29493 - RNA, 1617 nt, Artificial Sequence
  derived and/or modified sequence opt5 from VP1__Norovirus_and/or_Norovirus-like__LC018707
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcuaauuuuucuccuaagcugggcagagugcaauucgagacagauaccgaccaugauuuugaaguuaaccagaauaccaaauucacacccgugggggucauccaggacggaagcaccacacaccggaacgagccccaacagugggugcucccuuccuacagcggccgcaauacgccgaacgugcaccuggcccccgccguugcuccuaccuuucccggcgaacagcuucuguucuuuagaucuacaaugccuggguguuccggauaucccaauauggaucucgacugccugcugccucaggaguggguccaauacuucuaucaggaggccgcgcccgcucagagcgauguggcccuccugcgguuugugaacccggacaccggcagaguccuuuucgaauguaagcugcauaaaucuggguacgugacaguugcccacaccggacagcaugaucucgugauuccucccaacggcuauuuucgcuucgacagcugggucaaucaauucuacacgcuggcuccuauggggaacggcaccggacggagacgcuga

SEQ ID NO: 29494 - RNA, 1617 nt, Artificial Sequence
  derived and/or modified sequence opt5 from VP1__Norovirus_and/or_Norovirus-like__KM982955
augaagauggccagcuccgacgcuacccccucugauggcagcgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuacaguguccccucggaacgcgcccggagagauucuguggucugccccucuuggcccggaucugaaucccuaccucagccaccuggcucgcauguauaacggguacgccggaggcuucgaaguccaggugauccuugcuggcaaugccuuuacggcggggaaaguuauuuucgccgcugugccucccaacuuuccuaccgagggacugucccccucucaggucacaauguucccgcauaucgugguggacgucagacaacucgagccuguucugaucccccugccugaugugcggaauaacuuuuaucacuacaaucagagcaacgaccccaccauuaagcucaucgccaugcuguauacaccccuucgcgcuaauaacgccggcgaugacguguucaccgucuccugcagagugcugacacggccuagcccggauuuugacuucauuuuucucguucccccuaccguggaaucucgcacgaaacccuucuccgucccugugcugaccguugaggaaaugacaaacagcagauuucccaucccgcuugagaagcuguucaccgggccuucuuccgccuucgugguccagccccagaauggacgguguacaaccgauggcgugcuccuggggacgacacaacugagcccugucaacauuugcaccuuucgcggagacgugacacauaucaccggcucucacaauuacaccaugaaccucgcuucccagaauuggaacaauuaugaucccacagaggaaauuccugcgccccugggcacgccggacuucguugggaaaauccagggagugcuuacccagacaaccagaacagacggcagcacccgggggcauaaggccacggucuacacaggauccgcugauuuugccccuaagcugggccgcgugcaauucgagaccgacaccaaccacgauuuugaagccaaucagaacacaaaauucacccccguuggggugauccaggacggaucuacaacgcacagaaaugagccccaacaguggguccucccuagcuacuccggccggaacacccauaaugugcaccuggcuccggccguggcgcccacauuuccuggcgaacagcuucuguucuuucgcagcaccaugcccggguguucuggauauccuaacauggaucucgacugccugcugccccaggaguggguucaauacuucuaucaggaggcugccccugcccaguccgaugucgcucuccugagauuugugaaucccgacacaggccgggugcuuuucgaauguaagcugcauaaaagcggguacgucaccguggcccacacgggacagcacgaucucguuauuccgccuaacggcuauuuuagauucgacucuugggugaaccaauucuacacccuggcucccauggggaauggcacaggacgccggagauga

SEQ ID NO: 29495 - RNA, 1617 nt, Artificial Sequence
  derived and/or modified sequence opt5 from VP1__Norovirus_and/or_Norovirus-like__KM982949
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacaucacccauauuacaggcucuagaaacuacaccaugaaucucgcuucccagaacuggagcaauuaugaucccaccgaggaaaucccugcgccccugggcacaccggacuucguggggaaaauccagggaguucuuacgcagaccacacggaccgacggcuccacacgcgggcacaaggccaccguguacacgggaucugcugauuuugccccuaagcugggcagaguccaauucgggacagacaccgaucaugacuuugaggccaaccagaauaccaaauucacacccgugggaguuauucaggauggcagcaccacacaccggaacgaaccccaacagugggugcucccuuccuacagcggccgcaauacgccgaacguccaccuggcucccgccguggcgccuaccuuucccggggagcagcuucuguucuuuagaucuacaaugccuggauguuccggcuaucccaauauggaccucgauugccugcugccucaggaaugggugcaauacuucuaucaggaggcugcccccgcccagagcgacguugcucuccugcgguuugucaacccggauaccgggagagugcuuuucgaguguaagcugcauaaaucuggauacgugacagucgcccacaccggccagcaugaccucgugaucccucccaauggguauuuucgcuucgauagcuggguuaaccaauucuacacgcuggcuccuaugggcaacggaaccggccggagacgcuga

SEQ ID NO: 29496 - RNA, 1617 nt, Artificial Sequence
  derived and/or modified sequence opt5 from VP1__Norovirus_and/or_Norovirus-like__KM406485
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaguuauuuucgccgcugugccucccaacuuuccuacggagggacugagccccucccaggucaccauguucccgcauaucgugguggacgucagacaacucgagccuguucugaucccccugccugaugugcggaauaacuuuuaucacuacaaucagucuaacgaccccacaauuaagcucaucgccaugcuguauacaccccuucgcgcuaacaaugccggcgaugacguguucaccgucagcugcagagugcugacccggccuuccccggauuuugacuucauuuuucucguucccccuacaguggaaagccgcaccaaacccuucucugucccugugcugacgguugaggaaaugaccaacuccagauuucccaucccgcuugagaagcuguucacagggccuagcucugccuucgugguccagccccagaauggacgguguaccacagauggcgugcuccuggggaccacgcaacuguccccugucaacauuugcacauuucgcggagacgugacccauaucacaggcagcagaaauuacaccaugaaccucgcuucucagaauuggaacaauuaugaucccaccgaggaaauuccugcgccccugggcacaccggacuucguugggaaaauccagggagugcuuacgcagaccacacggaccgacggcuccacacgcgggcacaaggccaccgucuacacgggaagcgcugauuuugccccuaagcugggcagagugcaauucgagacagacaccgaucaugacuuugaagccaaccagaauaccaaauucacacccguuggggugauccaggauggauccaccacacaccggaacgagccccaacaguggguccucccuucuuacagcggccgcaauacgccgaacgugcaccuggcucccgccguggcgccuaccuuucccggcgaacagcuucuguucuuuagauccacaaugccuggguguagcggauaucccaauauggaccucgauugccugcugccucaggaguggguucaauacuucuaucaggaggcugcccccgcccagucugacgucgcucuccugcgguuugugaacccggauaccggcagagugcuuuucgaauguaagcugcauaaauccggguacgucacaguggcccacaccggacagcaugaccucguuauuccucccaacggcuauuuucgcuucgauagcugggugaaucaauucuacacgcuggcuccuauggggaacggcaccggacggagacgcuga

SEQ ID NO: 29497 - RNA, 1617 nt, Artificial Sequence
  derived and/or modified sequence opt5 from VP1__Norovirus_and/or_Norovirus-like__KM198574
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagagacuacaccaugaaccucgcgagccugaauuggaacaauuaugauccuacagaagagauucccgccccucuugggacgcccgacuucgugggaaaaauccagggcguccugacccagacaaccaagggggacggaucuacacggggccacaaggcuaccguguacacgggguccgccccguuuacaccuaaacucggaagcguucaguucuccaccgauaccgaaaacgacuuugagacacaucaaaauaccaaguucacacccgugggcgucauucaggauggcgggacgacccaccgcaacgaaccccagcaaugggugcugccuucuuacagcggaagagacguucacaaugugcaucuugccccggcugucgcccccacauuuccuggcgagcagcuccuguucuuucgguccaccaugcccggguguagcggauauccuaacauggaucuggacugccugcucccccaggagugggugcagcacuucuaccaagaagcggcuccugcccagucugauguggcccugcuucgcuuuguuaaucccgacacaggcagaguccuguucgaguguaaacuccauaaguccggguaugugaccguggcucacacgggccagcacgaucuggucaucccgccuaacggauacuuucgguucgacagcugggugaaucaguucuauacccuugcccccaugggcaacgggacaggaagacgccgguga

SEQ ID NO: 29498 - RNA, 1617 nt, Artificial Sequence
  derived and/or modified sequence opt5 from VP1__Norovirus_and/or_Norovirus-like__KM198517
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagauuaaugaccccacaaucaagcucauugccaugcuguauacaccccuucgcgcuaacaacgccggcgaagauguuuucaccgugagcugcagagugcugacccggccuuccccggacuuugauuucaucuuucucgugcccccuacagucgagagccgcaccaaacccuucacgguuccuauucugaccguggaagagaugacaaauucuagauuucccaucccgcuugagaagcuguucaccgggccuuccggagccuucgucgugcagccccagaacggccgguguacaaccgacgggguucuccugggaacgacacaacugagcccugugaauaucugcaccuuucgcggcgaugucacacauauugcuggcucuagaaacuacaccaugaaucucgcgucccugaacuggaauaacuaugaccccaccgaagagaucccugcuccccuugggacaccggauuucgugggaaaaauucagggcguccugacgcagaccacaaagggggacggaagcacccggggccacaaggccacaguguacaccgggucugccccuuuuacgcccaaacucggauccguucaguucagcacagacaccgaaaaugauuuugagacccaucaaaacacaaaguucacccccgugggcgucauccaggacggcuccacaacgcaccgcaaugaaccucagcaaugggugcugccgucuuacagcgggagagauauucacaacguucaucuugcccccgcuguggccccuaccuuucccggagagcagcuccuguucuuucgguccacaaugccuggcuguagcggguaucccaauauggaccuggauugccugcucccucaggaguggguccagcacuucuaccaagaagcggcucccgcccagucugacguggcccugcuucgcuuugugaacccggauaccggaagaguucuguucgaguguaaacuccauaaguccggcuaugucacaguggcucacaccgggcagcacgaccuggugaucccucccaauggcuacuuucgguucgauagcugggucaaccaguucuauacgcuugccccuaugggaaacggcaccgggagacgccgguga

SEQ ID NO: 29499 - RNA, 1617 nt, Artificial Sequence
  derived and/or modified sequence opt5 from VP1__Norovirus_and/or_Norovirus-like__JX439839
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucucacaacuacaccaugaaucucgcgucccugaacuggaauaacuaugacccuaccgaagagauucccgccccucuuggcacacccgauuucguggggaaaauccagggaguccugacgcagaccacaaagggcgacgggagcaccagaggacauaaggcuacaguguacaccggcuccgccccguuuacgccuaaacucgggucuguucaguucagcacagacaccgaaaaugauuuugagacccaccaaaacacaaaguucacccccgugggagucauucaggacggcggcacaacgcaccggaaugaaccccagcaaugggugcugccuuccuacagcgggcgcaacguuccgaaugugcaucuugcccccgcugucgccccuaccuuucccggagagcagcuccuguucuuuagaucuacaaugccuggcuguuccggguaucccaacauggaucuggacugccugcucccucaggagugggugcagcacuucuaccaagaagcggcucccgcccagagcgauguggcccugcuucgguuuguuaauccggacaccggacgcguccuguucgaguguaaacuccauaagucuggcuaugugacaguggcucacaccgggcagcacgaucuggucaucccucccaacggcuacuuuagauucgacagcugggugaaccaguucuauacgcuugccccuaugggaaauggcaccgggcggagacgcuga

SEQ ID NO: 29500 - RNA, 1617 nt, Artificial Sequence
  derived and/or modified sequence opt5 from VP1__Norovirus_and/or_Norovirus-like__JX439837
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcucugccuucgucgugcagccucagaauggacgguguaccacggacggcguucuccuggggacaacccaacugucccccgugaacaucugcacauuucgcggagaugucacccauaucgccggcagcagaaauuacaccaugaaccucgcuucucugaauuggaacaauuaugacccuacagaagagauucccgcgccucuuggcacgcccgauuucguggggaaaauccagggaguccugacccagacaaccaagggcgacggguccacacggggacacaaggccaccguguacacgggcagcgcuccguuuacaccuaaacucggguccguucaguucucuaccgacaccgaaaacgauuuugagacacaucaaaauaccaaguucacacccgugggagucauucaggacggcggcacgacccaccgcaacgaaccccagcaaugggugcugccuagcuacuccgggagaaauguucagaacgugcaccuugccccggccgucgcucccacauuuccuggagagcagcuccuguucuuucggagcaccaugcccggcuguucuggguauccuaauauggaucuggacugccugcucccccaggagugggugcaacauuucuaccaggaagccgcgccugcucaguccgauguggcccugcuucgcuuuguuaaccccgacacaggaagaguccuguucgaguguaaacuccacaagagcggcuaugugaccguggcccauacggggcagcacgaucuggucaucccgccuaacggcuacuuucgguucgacucuugggugaaucaauucuauacccuugcucccaugggaaacggcacagggagacgccgguga

SEQ ID NO: 29501 - RNA, 1617 nt, Artificial Sequence
  derived and/or modified sequence opt5 from VP1__Norovirus_and/or_Norovirus-like__KC631815
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcaaaauccaggggguccuuacccaaacaaccagacgggacggaagcacacgcggccacaaggccaccguguccacggggucuguucauuuuacaccuaagcugggacggauucaguucagcaccgauaccuccaacgacuuugaaacaggccagaauaccagauucacacccgugggggucgugcaagauggaagcacgacccaccagaacgagccccagcaguggguucucccuaauuacucuggccgcgacucccacaacgugcaucuggcuccggccgucgcccccagcuuuccuggcgaacaacuucuguucuuuagaucuacaaugcccggguguagcggauacccuaauaugaaccucgauugccugcugccccaggagugggugcagcacuucuaucaggaggcugccccugcgcaauccgacguggcucuccugcgguuuguuaaucccgauaccggcagaguccuuuucgaauguaaacugcauaagucuggguacgugacaguggcccacaccggacagcacgaccucgucaucccgccuaacggcuauuuucgcuucgauagcugggugaaccaguucuacacgcuggcccccauggggaauggcaccggacggagacgcuga

SEQ ID NO: 29502 - RNA, 1617 nt, Artificial Sequence
  derived and/or modified sequence opt5 from VP1__Norovirus_and/or_Norovirus-like__KC409315
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaagaugacuuugagacacaucaaaauaccaaguucacacccgugggcgucauucaggauggcgggacgacccaccgcaacgaaccccagcaaugggugcugccuucuuacagcggaagagacguucacaaugugcaucuugccccggcugucgcccccacauuuccuggcgagcagcuccuguucuuucgguccaccaugcccggguguagcggauauccuaacauggaucuggacugccugcucccccaggagugggugcagcacuucuaccaagaagcggcuccugcccagucugauguggcccugcuucgcuuuguuaaucccgacacaggcagaguccuguucgaguguaaacuccauaaguccggguaugugaccguggcucacacgggccagcacgaucuggucaucccgccuaacggauacuuucgguucgacagcugggugaaucaguucuauacccuugcccccaugggcaacgggacaggaagacgccgguga

SEQ ID NO: 29503 - RNA, 1617 nt, Artificial Sequence
  derived and/or modified sequence opt5 from VP1__Norovirus_and/or_Norovirus-like__KC409289
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugaccccaccauuaagcucaucgccaugcuguauacaccccuucgcgcuaacaacgccggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaauucuagauuucccauuccgcuugagaagcuguucacagggccuuccggagccuucgucgugcagccccagaacggccgguguaccacggacgggguucuccugggaacaacccaacugagcccugugaauaucugcacauuucgcggcgaugucacccauaucgcuggcucuagaaacuacaccaugaaucucgcgucccugaacuggaauaacuaugaccccacagaagaggugccugcuccccuugggacgccggauuucgucggaaaaauucagggcgugcugacccagacaaccaagggggacggaagcacacggggccacaaggccaccguuuacacggggucugccccuuuuacacccaaacucggauccgugcaguucagcaccgacaccgaaaaugauuuugagacacaucaaaacaccaaguucacacccgucggcgugauccaggacggcgggacgacccaccgcaaugaaccucagcaauggguucugccguccuacucuggaagagaugugcacaacguccaucuugcccccgcuguggccccuacauuucccggcgagcagcuccuguucuuucggagcaccaugccuggguguuccggauaucccaauauggaccuggauugccugcucccucaggagugggugcagcacuucuaccaagaagcggcucccgcccagagcgacguugcccugcuucgcuuugucaacccggauacaggcagagugcuguucgaguguaaacuccauaagucuggguaugugaccgucgcucacacgggccagcacgaccuggugauuccucccaauggauacuuucgguucgauuccuggguuaaccaguucuauacccuugccccuaugggcaacgggacaggaagacgccgguga

SEQ ID NO: 29504 - RNA, 1617 nt, Artificial Sequence
  derived and/or modified sequence opt5 from VP1__Norovirus_and/or_Norovirus-like__KC409278
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugaggcccaucaaaauaccaaguucacacccgugggcgucauucaggacggcgggaccacacaccgcaacgaaccccagcaaugggugcugccuucuuacagcggaagagauguucacaaugugcaucuugcuccggccgucgcgcccacguuuccuggcgagcagcuccuguucuuucgguccaccaugcccggguguagcggauauccuaacauggaccuggauugccugcucccccaggagugggugcagcacuucuaccaagaagcugccccugcccagucugacguggcucugcuucgcuuuguuaaucccgauacaggcagaguccuguucgaguguaaacuccauaaguccggguaugugaccguggcccacacaggccagcacgaccuggucaucccgccuaacggauacuuucgguucgauagcugggugaaccaguucuauacccuugcucccaugggcaaugggacgggaagacgccgguga

SEQ ID NO: 29505 - RNA, 1617 nt, Artificial Sequence
  derived and/or modified sequence opt5 from VP1__Norovirus_and/or_Norovirus-like__KC175402
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcuccacaacgcaccgcaaugaaccccagcaaugggugcugccuagcuacucuggcagaaacguuccgaaugugcaccuugcccccgcugucgccccuaccuuucccggggagcagcuccuguucuuucgguccacaaugccuggauguagcggcuaucccaacauggaucuggacugccugcucccucaggagugggugcagcauuucuaccaagaagcggcucccgcccagucugauguggcccugcuucgcuuuguuaauccggacaccgggagaguccuguucgaguguaaacuccacaagagcggauaugugacaguggcucauaccggccagcacgaucuggucaucccucccaacggguacuuucgguucgacuccugggugaaccaguucuauacgcuugccccuaugggcaauggaaccggcagacgccgguga

SEQ ID NO: 29506 - RNA, 1617 nt, Artificial Sequence
  derived and/or modified sequence opt5 from VP1__Norovirus_and/or_Norovirus-like__JX459616
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcgggacaacgcaccgcaacgaaccccagcaaugggugcugccuucuuacagcggaagaaauguucacaacgugcaucuugccccggcugucgcccccaccuuuccuggcgagcagcuccuguucuuucgguccacaaugcccggguguagcggauauccuaauauggaucuggacugccugcucccccaggagugggugcagcacuucuaccaagaagcggcuccugcccagucugauguggcccugcuucgcuuuguuaaccccgacaccggcagaguccuguucgaguguaaacuccauaaguccggguaugugacaguggcucacaccggccagcacgaucuggucaucccgccuaacggauacuuucgguucgacagcugggugaaucaguucuauacgcuugcccccaugggcaacgggaccggaagacgccgguga

SEQ ID NO: 29507 - RNA, 1617 nt, Artificial Sequence
  derived and/or modified sequence opt5 from VP1__Norovirus_and/or_Norovirus-like__JX459599
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccugagccgcauguauaauggguacgccggaggcuucgaaguccaggugauccuugcuggcaacgccuuuaccgcugggaaaauuaucuucgccgcgguuccucccaauuuuccuacagagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacggucgaaucucgcaccaaacccuucuccguuccuauccugacaguggaggaaaugaccaauagcagauuucccauuccgcuugagaagcuguucacagggccuucuuccgcuuucgucgugcagccccagaacggacgguguaccacggauggcguucuccuggggacaacccaacugagcccugugaauaucugcacauuucgcggaaacgucaccaauaucgccggcucucagaccuacacaaugaaccucgccucccagaauuggaacaauuaugaccccacggaggaaauuccugcuccccugggcaccccggauuucguggggagaauccagggaguccuuacacaaaccacacggggcgacgggagcacccgcggacauaaagcgacgguguccacaggcucugccuacuuuaccccuaagcuggggagcguucaguucuccaccgacacaagcaccgauuuugagacaggacagaacacgagauucacccccgugggcgucgugcaagacggcucuacaacccacaagaaugaaccccagcaguggguucucccuuccuacagcgggcgggauucucauaacgugcaccuggcuccggccgucgcccccacauuuccuggagagcagauucuuuucuuucgcagcaccaugcccggcuguuccggguauccuaauauggaccuggauugccuccugccccaagaaugggugcagcacuucuaccaggagucugcuccugcccagagcgacguggcgcugcucagauuuguuaaccccgauacgggacggguccuguucgaguguaaacuucauaaguccggcuaugugaccguggcucacacagggcaacaugaccuggucaucccgccuaauggcuacuuuagauucgauagcugggugaaccaguucuauacccucgcccccaugggaaacggcgccgggcgccggagauga

SEQ ID NO: 29508 - RNA, 1617 nt, Artificial Sequence
  derived and/or modified sequence opt5 from VP1__Norovirus_and/or_Norovirus-like__JN400603
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagauuaccaagggcgacggguccacacggggacacaaggcuaccguguacacaggcggggccccguuuaccccuaaacucggaagcguucaguucuccacggacacagaaaacgauuuugagacccaucaaaauaccaaguucacacccgugggcgucauccaggacggcucuaccacacaccgcaacgaaccccagcaaugggugcugccuagcuacuccgggagaaauguucacaacgugcaucuugccccggcugucgcccccacguuuccuggagagcagcuccuguucuuucggagcaccaugcccggcuguucuggguauccuaauauggaucuggacugccugcucccccaggagugggugcagcacuucuaccaagaagcggcuccugcccaguccgauguggcccugcuucgcuuuguuaaccccgacacaggaagaguccuguucgaguguaaacuccauaagagcggcuaugugaccguggcucacacagggcagcacgaucuggucauuccgccuaacggcuacuuucgguucgacucuugggugaaucaguucuauacccuugcccccaugggaaacggcacggggagacgccgguga

SEQ ID NO: 29509 - RNA, 1617 nt, Artificial Sequence
  derived and/or modified sequence opt5 from VP1__Norovirus_and/or_Norovirus-like__JQ613572
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagacacugugguccgccccucuuggcccggaucugaaucccuaccucucucaccuggcucgcauguauaacggguacgccggaggcuucgaaguccaggugauucuugcuggcaaugccuuuacggcggggaaaaucauuuucgccgcuguuccucccaacuuuccuaccgagggacugagccccucccaggugacaauguucccgcauaucaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaugacguuuucaccguguccugcagagugcugacacggcccagcccugauuuugacuucaucuuucucgucccgcccaccguggaaucucgcacgaaaccuuucaccguucccauucugacaguggaggaaaugaccaacuccagauuuccuaucccccuugagaagcuguucacagggccgagcucugccuucgucgugcagccucagaauggacgguguaccacggauggcguucuccuggggacaacccaacugucccccgugaacauuugcacauuucgcggagacgucacccauaucgcuggcagcagaaauuacaccaugaaccucgcgucucugaauuggaacaauuaugauccuacagaggaaauccccgccccucuuggcacgcccgacuucguggggaaaauucagggaaugcugacccagacaacccagggcgacggguccacacggggacacaaggcuaccgucuacacgggcagcgccgauuuuacaccgaagcucggguccgugcaauucgccaccgacaccgagaacgauuuugaaacacaucagaauaccaaauucacaccuguuggagugauccaggacggcucuacgacccaccgcaacgagccccaacagugggcucugcccagcuacuccggcagaagcgcccacaauguccaucuugcgccugcuguggccccgaacuuucccggggaacagcuccuguucuuucggucuacaaugccuggauguuccggcuaucccaauauggaucuggacugccugcucccucaggaguggguucaacacuucuaccaggaggccgcucccgcccagagcgauguggcucugcuucgcuuugucaacccugacaccgggagagugcuguucgaauguaagcuccauaaaucuggauaugugacaguugcccacaccggccagcacgaucuggucauucccccgaacggguacuuucgguucgacagcugggugaaucaauucuauacgcuugcgccuaugggcaacggaaccggcagacgccgguga

SEQ ID NO: 29510 - RNA, 1617 nt, Artificial Sequence
  derived and/or modified sequence opt5 from VP1__Norovirus_and/or_Norovirus-like__JQ613525
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucucuacagacaccgagaacgauuuugaaacccaucaaaauacaaaguucaccccugugggagucauucaggacggcagcacaacgcaccgcaacgagccccagcaaugggugcugcccuccuacagcggcagaaauguucacaacgugcaucuugccccugcugucgccccgaauuuucccggggaacagcuccuguucuuucggucuaccaugccuggauguuccggcuaucccaacauggaucuggacugccugcucccucaggagugggugcagcacuucuaccaagaggcggcucccgcccagagcgauguggcccugcuucgcuuuguuaacccugacacagggagaguccuguucgaauguaaacuccauaagcccggauaugugaccguggcucacacaggccagcacgaucuggucaucccgccuaauggguacuuucgguucgacucuugggugaaccaguucuauacccuugcccccaugggcaauggagcuggcagacgccgguga

SEQ ID NO: 29511 - RNA, 1617 nt, Artificial Sequence
  derived and/or modified sequence opt5 from VP1__Norovirus_and/or_Norovirus-like__JQ613510
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacgcgaugaaccucgccucucugaauuggaacaauuaugacccuaccgaagagauucccgcuccucuuggcacccccgauuucguggggaaaauccagggacugcucacacagacgaccaagggcgacggguccacacggggacacaaggccaccgucuacacaggcagcgccccguuuaccccuaaacugggguccgugcaguucucuacggacacagaaaacgauuuugagacccaucaaaauaccaaguucacacccguuggagugauucaggacggcagcaccacacaccgcaacgaaccccagcaauggguccuuccuuccuacagcggcagaaaugugcacaacguucaucuggcuccggccguggcgcccacguuuccuggggagcagcuccuguucuuucggucuaccaugcccggauguuccggcuauccuaauauggaucuggacugccuccugccccaggaguggguccagcacuucuaccaagaagcugccccugcccagagcgauguggcccuucugcgcuuugugaaccccgacacagggagaguucucuucgaguguaaacugcauaagucuggauaugucaccguggcucacacaggccagcacgaucuugugaucccgccuaacggguacuuucgguucgacagcugggucaaucaguucuauacccuggcucccaugggcaacggaacgggcagacgccgguga

SEQ ID NO: 29512 - RNA, 1617 nt, Artificial Sequence
  derived and/or modified sequence opt5 from VP1__Norovirus_and/or_Norovirus-like__GQ856450
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccagcacagcggggaaaauuaucuuugccgcuguuccucccaacuucccuacggagggacugucccccucucaggugaccauguuuccgcauaucauugucgacgugagacaacucgagccugugcugaucccccugccugauguccggaauaacuucuaucacuacaaucagagcaacgacuccacaauuaagcucaucgccaugcuguauacaccccuucgcgcuaacaaugccggcgaagauguuuuuaccgugagcugcagagugcugacccggcccucuccugacuucgauuuuauuuuccucgucccgcccacaguggagucccgcaccaaaccuuuuacgguucccauccugaccguggaagagaugacaaacagcagauucccuauuccccuugagaagcuguuuaccgggccgucuuccgccuucgucgugcagccucagaauggacgguguacaaccgacggcguucuccuggggacgacacaacugagccccgugaacaucugcaccuuccgcggagaugucacacauaucgcuggcacccacaauuacaccaugaaccucgcgucucugaauuggaacaauuaugacccuacagaagagauucccgccccucuuggcacgcccgauuuuguggggaaaauccagggaguccugacccagacaaccaagggcgacggguccacaagaggacauaaggcuaccguguacacgggcagcgccccguucacaccuaaacucggguccguucaguuuucuaccgacaccgaaaacgauuucgagacacaccaaaauaccaaguuuacacccgugggagucauucaggacggcagcacgacccaccggaacgaaccccagcaaugggugcugccuuccuacagcggcgggaauguucagaacgugcaucuugccccggcugucgcccccacauucccuggagagcagcugcucuuuuuccgcucuaccaugcccggcuguuccggguauccuaauauggaucuggacugccugcucccccaggagugggugcaacacuuuuaccaggaagcggcuccugcccagagcgauguggcccugcuuagauucguuaaccccgacacaggacggguccuguuugaguguaaacuccauaagucuggcuaugugaccguggcucacacggggcagcacgaucuggucaucccgccuaacggcuacuuccgcuuugacagcugggugaaucaauucuauacccuugcccccaugggaaacggcacagggagacggagauga

SEQ ID NO: 29513 - RNA, 1617 nt, Artificial Sequence
  derived and/or modified sequence opt5 from VP1__Norovirus_and/or_Norovirus-like__AB541296
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucauccauauugcuggcuccagaaauuacacaaugaaccucgcggcccugaauuggaacaauuaugacccuaccgaagagauccccgcuccucuugggacccccgauuucgugggaaaaauucagggcguccugacacagacgaccaagggggacggaagcacacggggccacaaggccaccguguacacagggucugccgacuuuaccccgaaacucggauccguucaguucagcacggauacagaaaacgacuuugagacccaucaaaauaccaaguucacaccugugggcgucauccaggauggcuccaccacacaccgcaacgaaccccagcaaugggugcugcccucuuacagcgggagaaauguucacaacgugcaucuugcuccugccgucgcgccgacguuucccggagagcagcuccuguucuuucgguccaccaugccuggcuguagcggguaucccaauauggaccuggauugccugcucccucaggagugggugcagcacuucuaccaagaagcugcccccgcccagucugacguggcucugcuucgcuuuguuaacccugauacaggaagaguccuguucgaguguaaacuccauaaguccggcuaugugaccguggcccacacagggcagcacgaccuggucauucccccgaacggcuacuuucgguucgauagcugggugaaucaguucuauacccuugcuccuaugggaaacggcacggggagacgccgguga

SEQ ID NO: 29514 - RNA, 1617 nt, Artificial Sequence
  derived and/or modified sequence opt5 from VP1__Norovirus_and/or_Norovirus-like__AB541212
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagagacuacaccaugaaucucgcgucucugaacuggaauaacuaugauccuaccgaagagauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucgcuucucuacagauaccgaaaaugacuuugagacccaucagaacacaaaguucacccccgugggagucauucaagauggcagcacaacgcacagaaaugaaccccagcagugggugcugccuuccuacagcggccgggacguucacaacgugcaucuugccccggcugucgcccccaccuuuccuggggagcaacuccuguucuuucgcucuacaaugcccggauguuccggcuauccuaauauggaucuggacugccugcucccccaggagugggugcagcacuucuaccaggaagcggcuccugcccaaagcgauguggcccugcuuagauuuguuaaccccgacaccgggcggguccuguucgaguguaaacuccauaagccgggauaugugacaguggcucacaccggccagcacgaucuggucaucccucccaauggguacuuuagauucgacucuugggugaaccaguucuauacgcuugccccuaugggcaacggaaccggccgccggagauga

SEQ ID NO: 29515 - RNA, 1617 nt, Artificial Sequence
  derived and/or modified sequence opt5 from VP1__Norovirus_and/or_Norovirus-like__AB504321
augaagauggccagcaacgacgcuaaucccuccgauggcucugccgcgaaccuggugccugaggucaauaacgaaguuauggcucucgagccgguggugggggccgccaucgcugcccccgucgcuggacagcaaaauauuaucgacccuuggauuagaaacaauuucgugcaggcccccggcggggaauuuaccguuagcccucggaacgcgcccggagagauccugugguccgccccucuuggcccggaucugaaucccuaccucucucaccuggcucgcauguauaacggguacgccggaggcuucgaagugcaggucauucuugcuggcaaugccuuuacagcggggaaaaucaucuucgccgcugugccucccaacuuuccuacggagggacugagccccucccagguuaccauguucccgcauauuaucguggacgucagacaacucgagccugugcugauuccccugccugaugugcggaauaacuuuuaucacuacaaucagucuaacgacagcacaaucaagcucauugccaugcuguauacaccccuucgcgcuaacaaugccggcgaagaugucuucaccguuuccugcagagugcugacccggcccagcccugacuuugauuucaucuuucucgugccgcccacagucgagucucgcaccaaaccuuucacggugcccauucugaccguugaagagaugacaaacuccagauuuccuaucccccuugagaagcuguucaccgggccgagcggagccuucgugguccagccucagaauggccgguguacaaccgacggggugcuccugggaacgacacaacugucucccguuaacaucugcaccuuucgcggcgaugugacacauauugcuggcaccagaaauuacaccaugaaccucgcgucccugaauuggaacaauuaugacccuacagaagagauccccgccccucuugggacgcccgauuucgucggaaaaauucagggcgugcugacccagacaaccaagggggacggaagcacacggggccacaaggcuaccgucuacacggggucugccccguuuacaccuaaacucggauccgugcaguucagcaccgacaccgaaaacgauuuugagacacaucaaaauaccaaguucacacccguuggcgugauccaggacggcgggacgacccaccgcaacgaaccccagcaauggguccugccuuccuacucuggaagaaaugugcacaacguucaucuugccccggcuguggcccccacauuuccuggcgagcagcuccuguucuuucggagcaccaugcccggguguuccggauauccuaauauggaucuggacugccugcucccccaggaguggguccagcacuucuaccaagaagcggcuccugcccagagcgauguggcccugaugcgcuuugugaaccccgacacaggcagaguucuuuucgaguguaaacugcauaagucuggguaugucaccguggcucacacgggccagcacgaucucgugauuccgccuaacggauacuuucgguucgacuccugggucaaucaguucuauacccuggcccccaugggcaacgggacaggaagacgccgguga

SEQ ID NO: 29516 - RNA, 1617 nt, Artificial Sequence
  derived and/or modified sequence opt5 from VP1__Norovirus_and/or_Norovirus-like__AB294785
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugacagcacaauuaagcucaucgcuaugcuguauacaccccuucgcgccaacaacgcuggcgaugacguuuucaccguguccugcagagugcugacccggcccagcccugauuuugacuucauuuuucucgucccgcccacgguggaaucucgcaccaaaccuuucuccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucgccggcacccagaacuacacaaugaaucucgcuucucagaacuggaauaacuaugauccuacggaggaaauucccgcgccucugggcacccccgacuucguggggaaaauccagggaguccuuacacaaaccacaagacgggacggcuccacccgcgggcacaaggccacggugagcacaggauccguucauuuuaccccgaagcugggcucugugcaguucagcaccgauacauccaaugacuuugagaccgggcagaacacaagauucacgccugucggagugguucaagauggcagcaccacacaccagaaugaaccccagcagugggugcuccccaacuacucuggccgggacucccacaauguccaucuggcuccugccguggccccgaccuuucccggggagcaacuucuguucuuucgcagcacaaugccuggauguucuggcuaccccaacaugaaucucgauugccugcugccucaggaaugggugcagcacuucuaucaggagagcgcucccgcccaauccgacguugcgcuccugagauuugucaacccugauaccgggcgggugcuuuucgaguguaaacugcauaagucuggauacgugacggucgcucacaccggccagcacgaccucgugauucccccgaacggguauuuuagauucgauagcuggguuaaucaguucuacacacuggccccuaugggcaacggagccggccgccggagauga

SEQ ID NO: 29517 - RNA, 1617 nt, Artificial Sequence
  derived and/or modified sequence opt5 from VP1__Norovirus_and/or_Norovirus-like__AB294780
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacaaaaggggacggauccacccggggccauaaggccacggucagcacaggggacgugcacuuuaccccuaagcugggaucuauucaauucaacaccgauacaaauaacgacuuugaaaccggccagaauacaaaauucacgcccguuggcgugguccaggaugggaacggaacccaccaaaaugagccccagcagugggugcucccuuccuacagcggccgcacagggcauaacguucaccuggcuccggccguggcccccaccuuuccuggagaacagcuucuguucuuuagauccacaaugcccggcuguucuggguacccuaacaugaaucucgacugccugcugccccaagaguggguccagcauuucuaucaggaggcugccccugcgcagagcgauguggcucuccugcgguuugugaaccccgacaccggccgcguucuuuucgaauguaagcugcacaaauccggauacgucacgguggcccacaccggccaacaugaucucgugaucccgccuaauggguauuuuagauucgacagcugggucaaccaguucuacacacuggcccccaugggaaauggcaccgggcggagacgcuga

SEQ ID NO: 29518 - RNA, 1617 nt, Artificial Sequence
  derived and/or modified sequence opt5 from VP1__Norovirus_and/or_Norovirus-like__AB303933
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaagauguuuucaccgugagcugcagagugcugacccggccuuccccggacuuugauuucauuuuucucgugcccccuacggucgagagccgcaccaaacccuucacaguuccuauccugaccguggaagagaugacaaauucuagauuucccauuccgcuugagaagcuguucaccgggccuuccggagccuucgucgugcagccccagaacggccgguguacgacagacgggguucuccugggaaccacacaacugagcccugugaauaucugcaccuuucgcggcgaugucacccauaucgccggcacacacaacuacacgaugaaucucgcuucucagaacuggaauaacuaugaccccaccgaagagauuccugcgccccuggggacaccggauuucgugggaagaauccagggcaugcuuacccagacaacccgcggggacggauccacgcggggccauaaagccacagucagcaccggggacgugcacuuuaccccuaagcugggaucuauucaauucaauacagauaccaacaaugacuuugaaacaggccagaacacgaaguucacccccguuggcgugguccaggaugggaauggaacacaccaaaacgagccccagcagugggugcucccuuccuacagcggcagaaccgggcauaauguucaccuggcuccggccguggcccccacauuuccuggagaacagcuucuguucuuucgguccaccaugcccggcuguucuggguacccuaacaugaaccucgacugccugcugccccaagaguggguccagcauuucuaucaggaggcugccccugcgcagagcgauguggcucuccugcgcuuugugaaucccgacacgggcagaguucuuuucgaauguaaacugcacaaguccggauaccucaccgucgcccacacaggccaacaugaucuggugaucccgccuaacggguauuuucgguucgacagcugggugaaucaguucuacacccuugcccccaugggaaacggcacagggagacgccgguga

SEQ ID NO: 29519 - RNA, 1617 nt, Artificial Sequence
  derived and/or modified sequence opt5 from VP1__Norovirus_and/or_Norovirus-like__AY587988
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcgccuuucgcggcgaugucacacauaucgcuggcacccacaauuacaccaugaaccucgcgucucagaauuggaacaauuaugaccccacagaagagauuccugcuccccuggggacgccggauuucgugggaagaauccagggcaugcuuacccagacaacccgcggggacggauccacacggggccauaaagccaccgucagcacgggggacgugcacuuuacaccuaagcugggaucuauucaauucaacaccgauaccaauaacgacuuugaaacaggccagaauaccaaguucacacccguuggcgugguccaggaugggaacggaacgcaccaaaaugagccccagcagugggugcucccuuccuacagcggcagaaccgggcauaacguucaccuggccccggccguggcucccacauuuccuggagaacagcuucuguucuuucgguccaccaugcccggcuguucuggguacccuaacaugaaucucgacugccugcugccccaagaguggguccagcauuucuaucaggaggccgcgccugcucagagcgauguggcccuccugcgcuuugugaaccccgacacaggcagaguucuuuucgaauguaaacugcacaagaccggauacgucacgguggcccacaccggccaacaugaucucgugaucccgccuaauggguauuuucgguucgacuccugggucaaccaguucuacacacuggcucccaugggaaauggcaccgggagacgccgguga

SEQ ID NO: 29520 - RNA, 1617 nt, Artificial Sequence
  derived and/or modified sequence opt5 from VP1__Norovirus_and/or_Norovirus-like__KX354103
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagcggcuguucacagggccuucuuccgccuucgugguccagccccagaacggacgcuguaccacagauggcgugcuccuggggaccacgcaacugagcccugucaauauuugcacauuuagaggagacgugacccauaucacaggcucucacaacuacaccaugaaucucgcuucccagaacuggaauaacuaugaucccaccgaggaaauuccugcgccccugggcacaccggacuucguugggaagauccagggagugcuuacgcagaccacacggaccgacggcagcacacgcgggcauaaagccaccgucuacacgggauccgcugaguuugccccuaagcugggcagagugcaauucgaaacagauaccaaucacgacuuugaggccaaccagaauaccaaguucacacccguuggggugauccaggauggaucuaccacacaccggaacgaaccccaacaguggguccucccuagcuacuccggccgcaauacgcauaacgugcaccuggcuccggccguggcgcccaccuuuccuggcgagcagcuucuguucuuuagaagcacaaugcccggguguucuggauauccuaauauggaccucgauugccugcugccccaggaguggguucaauacuucuaucaggaagcugccccugcccaguccgacgucgcucuccugcgguuugugaaccccgauaccggcagagugcuuuucgaguguaaacugcauaagagcggguacauuacagucgcccacaccggacagcacgaccucgugaucccgccuaacggcuauuuucgcuucgauucuuggguuaaucaauucuacacgcuggcucccauggggaacggcaccggacggagacgcuga

SEQ ID NO: 29521 - RNA, 1617 nt, Artificial Sequence
  derived and/or modified sequence opt5 from VP1__Norovirus_and/or_Norovirus-like__KX354048
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaucuaccacacaccggaaugagccccaacaguggguccucccuagcuacuccggccgcaacacgcacaaugugcaucuggcuccggccguggcgcccaccuuuccuggcgaacagcuucuguucuuuagaagcacaaugcccggguguucuggauauccuaacaccgaccucgauugccugcugccccaggaguggguucaauacuucuaucaggaggcugccccugcccaguccgacgucgcucuccugcgguuugugaaucccgauacaggcagagugcuuuucgaauguaagcugcacaaaagcggguacgucaccguggcccauacgggacagcacgaccucguuauuccgccuaacggcuauuuucgcuucgauucuugggugaaccaauucuacacccuggcucccauggggaauggcacaggacggagacgcuga

SEQ ID NO: 29522 - RNA, 1617 nt, Artificial Sequence
  derived and/or modified sequence opt5 from VP1__Norovirus_and/or_Norovirus-like__KX354047
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauuggaacaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccacacaccggaacgagccccaacaguggguccucccuuccuacagcggccgcaauacgcacaacgugcaucuggcuccggccguggcgcccaccuuuccuggcgaacagcuucuguucuuuagaucuacaaugcccggguguuccggauauccuaauauggaccucgauugccugcugccccaggaguggguucaauacuucuaucaggaggcugccccugcccagagcgacgucgcucuccugcgguuugugaaccccgauaccggcagagugcuuuucgaauguaagcugcacaaaucuggguacgucacaguggcccauaccggacagcacgaccucguuauuccgccuaauggcuauuuucgcuucgauagcugggugaaccaauucuacacgcuggcucccauggggaacggcgccggacggagacgcuga

SEQ ID NO: 29523 - RNA, 1617 nt, Artificial Sequence
  derived and/or modified sequence opt5 from VP1__Norovirus_and/or_Norovirus-like__KU985161
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuugccccuaagcugggccgcgugcaauucgccacagacaccgaucacgacuuugaggcuaaucagaacaccaaauucacacccguuggggugauccaggauggaucuaccacacacagaaaugaaccccaacaguggguccucccuagcuacuccggccggaacacgcauaaugugcaccuggccccggcgguggcucccaccuuuccuggcgagcagcuucuguucuuucgcagcacaaugcccggguguucuggauauccuaacauggaccucgauugccugcugccccaggaauggguucaauacuucuaucaggaggccgccccugcucaguccgacgucgcccuccugagauuugugaaucccgauaccggccgggugcuuuucgaguguaagcugcauaaaagcggguacgucacaguggcucacaccggacagcacgaccucguuauuccgccuaacggcuauuuuagauucgauucuugggugaaccaauucuacacgcuggcccccauggggaauggcaccggacgccggagauga

SEQ ID NO: 29524 - RNA, 1617 nt, Artificial Sequence
  derived and/or modified sequence opt5 from VP1__Norovirus_and/or_Norovirus-like__AB972517
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacaucacccauauuacaggcucuagaaacuacaccaugaaucucgcuucccagaacuggagcaauuaugaucccaccgaggaaaucccugcgccccugggcacaccggacuucguggggaaaauccagggaguucuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauucaggauggaagcaccacacaccggaacgagccccaacagugggugcucccuuccuacagcggccgcaauacgccgaacguccaccuggcucccgccguggcgccuaccuuucccggcgaacagcuucuguucuuuagaucuacaaugccuggguguuccggauaucccaauauggaccucgauugccugcugccucaggagugggugcaacauuucuaccaggaggcugcccccgcccagagcgacguugcucuccugcgguuugucaacccggauaccggcagagugcuuuucgaauguaagcugcacaaaucuggguaugugacagucgcccauaccggacagcacgaccucgugaucccucccaauggcuacuuucgcuucgauagcuggguuaaccaauucuauacgcuggcuccuauggggaacggcaccggacggagacgcuga

SEQ ID NO: 29525 - RNA, 1617 nt, Artificial Sequence
  derived and/or modified sequence opt5 from VP1__Norovirus_and/or_Norovirus-like__AB972494
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagauccaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcuaauuuugccccuaagcugggcagagugcaauucgagacagauaccgaccaugauuuugaagccaaccagaauaccaaauucacacccguuggggugauccaggacggauccaccacacaccggaacgagccccaacaguggguccucccuagcuacucuggccgcaauacgccgaacgugcaccuggcucccgccguggcgccuaccuuucccggcgaacagcuucuguucuuuagauccacaaugccuggguguagcggauaucccaauauggaucucgacugccugcugccucaggaguggguucaauacuucuaucaggaggcugcccccgcccagucugaugucgcucuccugcgguuugugaacccggacaccggcagagugcuuuucgaauguaagcugcauaaaagcggguacgucacaguggcccacaccggacagcaugaucucguuauuccucccaauggcuauuuucgcuucgacuccugggugaaccaauucuacacgcuggcuccuauggggaacggcaccggacggagacgcuga

SEQ ID NO: 29526 - RNA, 1617 nt, Artificial Sequence
  derived and/or modified sequence opt5 from VP1__Norovirus_and/or_Norovirus-like__KU311163
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaggacuccacaauuaaacucaucgccaugcuguauacaccccuucgcgcuaauaacgccggcgaugacguuuucaccgugagcugcagagugcugacccggcccucuccugauuuugacuucauuuuucucgucccgcccacaguggaaucccgcaccaagccuuucacgguucccauccugaccguggaggaaaugacaaacagcagauuuccuauuccccuugagaaacuguucaccgggccgucuaaugccuucgucgugcagccucagaacggacgguguacaaccgauggcguucuccuggggacgacacaacugucccccgugaauaucugcaccuuucgcggagacgucacacagaucgcuagcacccagaccuacacaaugaaccucgcgucucugaauuggaacaauuaugauccuacggaggaaauucccgccccucuuggcgcucccgacuucaugggcaagauccagggggugcugacccaaacaaccagacaggacggauccacacggggccauaaggccaccgucagcacgggguccgugcacuuuacaccgaaacucggaucuguucgcuucgauaccgacaccaacaauaaccugcagccucaucaaagcacaagauuuacccccgugggcgucauucaggauggggacacacaccagaaugagccccagcaaugggugcuuccuuguuacuccggacgggauguuaacaaugugcaccuggccccggcugucgcccccagcuucccuggcgaacagcuccuguuuuuccgcucuacgaugcccggcugcuccggguacccuaacauggaccuggauugucuccugccccaggagugggugcagcauuuuuaucaagaagcggcuccugcccagagcgacguggcccuucugagauucguuaaucccgauaccggacggguccucuuugagugcaagcugcacaaaucuggcuacgugacaguggcucauaccgggcagcacaaccuugucaucccgccuaacggauauuucagauuugacagcugggugaaucaguucuacacacuggcccccaugggcaacgggaccggccgccggagaguuuga

SEQ ID NO: 29527 - RNA, 1617 nt, Artificial Sequence
  derived and/or modified sequence opt5 from VP1__Norovirus_and/or_Norovirus-like__KR904236
augaagauggccagcuccgacgcuaacucuagcgauggcuccgccgcgaaucuggugcccgaggucaacaaugaaguuauggcucucgagccuguggugggggccgccaucgcugccccggucgcuggacagcaaaacgugauugaccccuggaucagaaauaacuucguucaggccccuggcggggaauuuaccgugucuccccggaaugcgccuggagagauucuguggagcgcuccccuuggcccugaucugaacccguaccucucccaccuggcccgcauguauaauggguacgccggaggcuucgaaguccaggugauccuugcuggcaacgccuuuacagcggggaaaauuaucuucgccgcuguucccccuaauuuucccacggagggacugucuccuagccaggugaccauguucccccauaucauugucgacgugagacaacucgagccggugcugaucccucugcccgauguccggaacaauuuuuaucacuacaaccaguccaaugacccuacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccauccugacgguggaggaaaugaccaauucuagauuuccuauuccccuugagaagcuguucacagggccguccagcgccuucgucgugcagccucagaacggacgguguaccacagauggcguucuccuggggaccacgcaacugucucccgugaauaucugcacauuucgcggagacgucacccauaucacaggcuccagaaacuacaccaugaaucucgcuacccagaacuggaauagcuaugauccuacagaggaaauucccgcgccucugggcacgcccgacuucguggggaaaauccagggaguccuuacccagacaaccaagacagacggcuccacccgggggcacaaggccacgguguacacaggaucugcugauuuugccccgaaacugggccgcguucaauucgccaccgacaccgauaacgacuuugaggcuaaucagaacacaaaguucaccccugugggggucauucaggauggaggcacaacgcauagaaaugaaccccaacagugggugcuccccagcuacuccggccggaacacccacaauguucaccuggccccugcgguggcuccgacauuucccggggagcagcuucuguucuuucgcagcaccaugccuggauguucuggcuaucccaacauggaccucgauugccugcugccucaggaauggguccaauacuucuaucaggaggccgcccccgcucaguccgacguggcccuccugagauuugugaauccugauacagggcggguucuuuucgaguguaaacugcauaagagcggauacgucaccguggcucacacgggcccccaugaccucgugaucccgccuaacggguauuuuagauucgauucuugggucaaccaguucuacacccuggcccccaugggcaauggaacaggccgccggagauga

SEQ ID NO: 29528 - RNA, 1617 nt, Artificial Sequence
  derived and/or modified sequence opt5 from VP1__Norovirus_and/or_Norovirus-like__KR904225
augaagauggccagcuccgacgcuaaccccucugagggcagcaccgccucccuggugccugaagucaauaacgagguuauggcgcucgaaccgguggcuggggccgccaucgcugcccccguggcuggacaggucaaugugauugauccuuggaucagaaacaauuucguucaagcccccggcggggaguuuacagugucuccucggaacgcgcccggagaaauucuguggagcgccccucuuggcccggaccugaaucccuaccucucccaccuggcucgcauguauaacggguacgccggaggcuucgagguccaggugauccuugcuggcaaugccuuuacggcggggaaaauuaucuucgccgcuguuccucccaacuuuccuaccgagggacugucucccagccaggugacaauguucccgcauaucauugucgaugugagacagcucgaaccugugcugaucccccugccugacguccggaauaacuuuuaucacuacaaucaauccaacgagcccaccauuaagcucguugccaugcuguauacaccccuucgcgcuaauaacgccggcgaugacguguucaccgugagcugcagaguccugacacggccuucuccggauuuugacuucaucuuucucgugcccccuaccguugaaucccgcacgaaacccuucagcgugccuauucugaccgucgaggagaugacaaacucuagauuucccaucccgcuugaaaagcuguucaccgggccuuccagcucuuucgugguucagccccagaauggacgguguacaaccgauggcgugcuccuggggacgacacagcuguccccugucaacauuugcaccuuucgcggagacgugacacauaucagcggcuccagaaaucacaccaugaaccucgccucucaaaauuggaacagcuacgaucccaccgaggaaaucccugcuccccugggcacaccggacuucgucgggaaaauucagggagugcuuacgcagaccacacgguccgauggcagcacccgcgggcauaaggcgacaguuuauaccggaucugccgacuuuuccccuaagcugggcagaauccaguucgcuacggacacagauaaugacuuugagaccaaccaaaauaccaaauucacacccgugggggucauucaggauggaggcaccacacaccggaacgaaccccagcaaugggugcucccuacguacagcggccgcaauacccacaacguucaucuggccccggccguggcucccacauuuccuggggagcagcuucuguucuuuagaucuaccaugcccggauguagcggcuacccugacauggaucucgacugccugcugccccaggaguggguccagcacuucuaucaagaagccgcgccugcucaguccgauguggcccuccugcgguuugugaaucccgacacagggagaguucuuuucgaguguaagcugcauaaagccggauacgucaccguggcucacacgggccagcacgaucucgugaucccgccuaacggguauuuucgcuucgacucuugggucaaucaguucuuuacccuggcccccaugggcaacggaacaggccggagacgcuga

SEQ ID NO: 29529 - RNA, 1617 nt, Artificial Sequence
  derived and/or modified sequence opt5 from VP1__Norovirus_and/or_Norovirus-like__LC005710
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccacccugacaguggaagagaugaccaacuccagauuuccuaucccccuugagaagcuguucacagggccgagcucugccuucgucgugcagccucagaauggacgguguaccacggacggcguucuccuggggacaacccaacugucccccgugaacauuugcacauuucgcggagaugucacccauaucgcuggcagcagagacuacaccaugaaucucgcgucucugaacuggaauaacuaugauccuacagaagagauccccgccccucuuggcacgcccgacuucguggggaaaauucagggaguccugacccagacaaccaagggcgacggguccacacggggacacaaggcuaccguguacacgggcagcgccccguuuacaccuaaacucggguccguucgcuucucuaccgauaccgaaaaugacuuugagacacaucagaacaccaaguucacacccgugggagucauccaagauggcagcacgacccacagaaaugaaccccagcagugggugcugccuuccuacagcggccgggacguucacaacgugcaucuugccccggcugucgcccccacauuuccuggggagcaacuccuguucuuucgcucuaccaugcccggauguuccggcuauccuaauauggaucuggacugccugcucccccaggagugggugcagcacuucuaccaggaagcggcuccugcccaaagcgauguggcccugcuuagauuuguuaaccccgacacagggcggguccuguucgaguguaaacuccauaagucuggauaugugaccguggcucacacgggccagcacgaucuggucauuccgccuaauggguacuuuagauucgacagcugggugaaccaguucuauacccuugcccccaugggcaacggaacaggccgccggagauga

SEQ ID NO: 29530 - RNA, 1617 nt, Artificial Sequence
  derived and/or modified sequence opt5 from VP1__Norovirus_and/or_Norovirus-like__LC018709
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaggggaaucucgcaccaaacccuucuccgugccuguccugacgguggaggaaaugaccaauagcagauuucccaucccgcuugagaagcuguucacaggaccuucuuccgccuucguugugcagccccagaacggccgguguaccacagaugggguccuccugggaaccacgcaacugagcccugugaauauuugcacauuucgcggcgacgucacccauacaaccggcucucacaacuacaccaugaaucucgcuucccagaacuggaauaacuaugaucccacagaggaaaucccugcgccccuggggacgccggacuucgugggaaaaauucagggcaugcuuacccagacaaccagaacagacgggagcacccggggacauaaggccacgguuuacacaggcuccgcugauuuugccccuaagcuggggcgcgugcaauucggaaccgacaccgaucacgaccucgaggccaaucagaacacaaaauuuacccccgucggcgugauccaggauggcucuacaacgcacagaaaugaaccccaacaguggguucugccuagcuacuccgggcggaacaccccgaaugugcaucuugcucccgccgucgcgccuacauuccccggagagcagcugcucuuuuuccgcagcaccaugccuggcuguucuggguaucccaacauggaccuggauugccugcucccucaggaaugggugcaauacuuuuaucaggaggcugcccccgcccaguccgacguggcucugcuuagauucguuaauccggauacaggacggguccuguuugaguguaagcuccacaaaagcggcuacgugaccguggcccauacggggcagcacgaccuggucaucccucccaacggcuauuucagauuugauucuugggugaaccaauucuacacccuugcuccuaugggaaauggcacagggcgccggagauga

SEQ ID NO: 29531 - RNA, 1617 nt, Artificial Sequence
  derived and/or modified sequence opt5 from VP1__Norovirus_and/or_Norovirus-like__KM198587
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaaggaagacgggucuacacggggacacaaggcuaccguguacacgggcuccgccccguuuacaccuaaacucgggagcguucaguucuccaccgacaccgagaaugauuuugaaacacaucaaaacaccaaguucacacccgugggagucauucaggacggcggcacgacccaccgcaaugagccccagcaaugggugcugccuucuuacagcgggagagauguucacaacgugcaucuugccccggcugucgcccccacauuuccuggagagcagcuccuguucuuucgguccaccaugcccggcuguagcggguauccuaauauggaccuggauugccugcucccccaggaaugggugcagcacuucuaccaagaggcggcuccugcccagucugacguggcccugcuucgcuuuguuaaccccgauacaggaagaguccuguucgaauguaaacuccauaaguccggcuaugugaccguggcucacacggggcagcacgaccuggucaucccgccuaauggcuacuuucgguucgauagcugggugaaccaguucuauacccuugcccccaugggaaacggcacagggagacgccgguga

SEQ ID NO: 29532 - RNA, 1617 nt, Artificial Sequence
  derived and/or modified sequence opt5 from VP1__Norovirus_and/or_Norovirus-like__KM198560
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucaucguccagccucagaauggccgguguacaaccgacggggugcuccugggaacgacacaacugucucccguuaacaucugcaccuuucgcggcgaugugacacauauugcuggcuccagaaauuacaccaugaaccucgcgagccugaauuggaacaauuaugacccuaccgaagagauccccgccccucuugggacacccgauuucgucggaaaaauucagggcgugcugacgcagaccacaaagggggacggaucuacccggggccacaaggcuacagucuacaccggguccgccccguuuacgccuaaacucggaagcgugcaguucuccacagacaccgaaaacgauuuugaggcccaucaaaauaccaaguucacacccguuggcgugauccaggacggcgggaccacacaccgcaacgaaccccagcaauggguccugccuucuuacagcggaagagaugugcacaauguucaucuugcuccggccguggcgcccacguuuccuggcgagcagcuccuguucuuucgguccaccaugcccggguguagcggauauccuaacauggaccuggauugccugcucccccaggaguggguccagcacuucuaccaagaagcugccccugcccagucugacguggcucugcuucgcuuugugaaucccgauacaggcagaguucuguucgaguguaaacuccauaaguccggguaugucaccguggcccacacaggccagcacgaccuggugauuccgccuaacggauacuuucgguucgauagcugggucaaccaguucuauacccuugcucccaugggcaaugggacgggaagacgccgguga

SEQ ID NO: 29533 - RNA, 1617 nt, Artificial Sequence
  derived and/or modified sequence opt5 from VP1__Norovirus_and/or_Norovirus-like__KM198521
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcgcuuuucgcggcgaugucacacauaucgcgggcuccagaaacuacaccaugaaucucgccagccugaacuggaauaacuaugacccuaccgaagagauucccgcuccucuugggacacccgauuucgugggaaaaauccagggcguccugacgcagaccacaaagggggacggaucuacccggggccacaaggccacaguguacaccggguccgccccguuuacgccuaaacucggaagcguucaguucuccacagacaccgaaaaugauuuugagacccaucaaaacacaaaguucacccccgugggcgucauucaggacggcgggacaacgcaccgcaaugaaccccagcaaugggugcugccuucuuacagcggaagagauguucacaacgugcaucuugcuccggccgucgcgcccaccuuuccuggcgagcagcuccuguucuuucgguccacaaugcccggguguagcggauauccuaauauggaccuggauugccugcucccccaggagugggugcagcacuucuaccaagaagcugccccugcccagucugacguggcucugcuucgcuuuguuaaccccgauaccggcagaguccuguucgaguguaaacuccauaaguccggguaugugacaguggcccacaccggccagcacgaccuggucaucccgccuaauggauacuuucgguucgauagcugggugaaccaguucuauacgcuugcucccaugggcaacgggaccggaagacgccgguga

SEQ ID NO: 29534 - RNA, 1617 nt, Artificial Sequence
  derived and/or modified sequence opt5 from VP1__Norovirus_and/or_Norovirus-like__KM198490
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgauaucacccauauugcuggcuccagagacuacaccaugaaccucgcgagccugaauuggaacaauuaugauccuacagaagagauccccgccccucuugggacgcccgacuucgucggaaaaauucagggcgugcugacccagacaaccaagcgggacgggucuacacgcggacacaaggcuaccgucuacacgggcuccgccccguuuacaccuaaacucgggagcgugagauucuccaccgauaccgaaaacgacuuugagacacaucagaauaccaaguucacacccguuggagugauccaagauggcucuacgacccaccggaacgaaccccagcaguggguccugccuagcuacuccggccgcgacgugcacaauguucaucuugccccggcuguggcccccacauuuccuggggagcaacuccuguucuuuagaagcaccaugcccggauguucuggcuauccuaacauggaucuggacugccugcucccccaggaguggguccagcacuucuaccaggaagcggcuccugcccaauccgauguggcccugcuucgguuugugaaucccgacacagggagaguucuguucgaguguaaacuccauaagagcggauaugucaccguggcucacacgggccagcacgaucuggugauuccgccuaacggguacuuucgcuucgacucuugggucaaucaguucuauacccuugcccccaugggcaacggaacaggccggagacgcuga

SEQ ID NO: 29535 - RNA, 1617 nt, Artificial Sequence
  derived and/or modified sequence opt5 from VP1__Norovirus_and/or_Norovirus-like__KC409241
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauauccccggcuccagaaauuacaccaugaaccucgccagccagaauuggaacuccuaugauccuaccgaggaaauccccgcuccgcugggcacaccugacuucgucgggaaaauucagggagugcuuacgcagaccacacggaccgacggcucuacacgcgggcacaaggcgaccguuuacacgggaagcgccgauuuuucccccaagcugggcagagugcaauucgcuacagacaccgauaaugacuuugagaccaaccagaauacaaaauucacccccgucggggugauccaggauggaagcacaacgcaucggaacgaaccucaacaguggguucucccgucuuacuccggccgcgacgugcacaauguccaccuggcccccgccguggcuccuaccuuucccggcgagcagcuucuguucuuuagaagcacaaugccuggguguucuggauaucccaacauggaucucgacugccugcugccucaggaaugggugcaauacuucuaucaggaggccgcgcccgcucagagcgauguugcccuccugcgguuugucaauccggacaccggcagagugcuuuucgaguguaagcugcauaaauccggguacgugacagucgcccacaccggacagcaugaucucgugauuccucccaacggcuauuuucgcuucgacucuuggguuaaucaauucuacacgcuggcuccuauggggaacggcaccggacggagacgcuga

SEQ ID NO: 29536 - RNA, 1617 nt, Artificial Sequence
  derived and/or modified sequence opt5 from VP1__Norovirus_and/or_Norovirus-like__JX459625
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcaccagaaauuacaccaugaaccucgcgucccugaauuggaacaauuaugacccuacagaagagauucccgccccucuugggacgcccgauuucgugggaaaaauccagggcguccugacccagacaaccaagggggacggaagcacacggggccacaaggcuaccguguacacggggucugccccguuuacaccuaaacucggauccguucaguucagcaccgacaccgaaaacgauuuugagacacaucaaaauaccaaguucacacccgugggcgucauucaggacggcgggacgacccaccgcaacgaaccccagcaaugggugcugccuuccuacucuggaagaaauguucacaacgugcaucuugccccggcugucgcccccacauuuccuggcgagcagcuccuguucuuucggagcaccaugcccggguguuccggauauccuaauauggaucuggacugccugcucccccaggagugggugcagcacuucuaccaagaagcggcuccugcccagagcgauguggcccugaugcgcuuuguuaaccccgacacaggcagaguccuuuucgaguguaaacugcauaagucuggguaugugaccguggcucacacgggccagcacgaucucgucaucccgccuaacggauacuuucgguucgacuccugggugaaucaguucuauacccuggcccccaugggcaacgggacaggaagacgccgguga

SEQ ID NO: 29537 - RNA, 1617 nt, Artificial Sequence
  derived and/or modified sequence opt5 from VP1__Norovirus_and/or_Norovirus-like__JX459613
augaagauggccagcaacgacgcucaccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccgugagcccucggaaugcgcccggagagauucugugguccgccccucuuggcccggaucugaaccccuaccucucucaucuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcacaucauugucgacgugagacaacucgagccugugcugaucccccugccugauguccggaacaauuuuuaucauuacaaccagucuaaugacagcacaauuaagcucaucgccaugcuguauacaccccuucgcgcuaacaacgccggcgaagauguuuucaccguguccugcagagugcugacccggcccagcccugacuuugauuucauuuuucucgucccgcccacaguggagucucgcaccaaaccuuucacgguucccauccugaccguggaagagaugacaaauuccagauuuccuauuccccuugagaagcuguucaccgggccgagcggagccuucgucgugcagccucagaacggccgguguacaaccgacgggguucuccugggaacgacacaacugucucccgugaauaucugcaccuuucgcggcgaugucacacacaucgcuggcuccagaaacuacaccaugaaucucgcgagccugaacuggaauaacuaugacccuaccgaagagauucccgccccucuugggacacccgauuucgugggaaaaauccagggcguccugacgcagaccacaaagggggacggaucuacccggggccauaaggcuacaguguacaccggguccgccccguuuacgccuaaacucggaagcguucaguucuccacagacaccgaaaaugauuuugagacccaccaaaacacaaaguucacccccgugggcgucauucaggacggcgggacaacgcaccgcaaugaaccccagcaaugggugcugccuucuuacagcggaagaaacguucauaaugugcaccuugccccggcugucgcccccaccuuuccuggcgagcagcuccuguucuuucgguccacaaugcccggguguagcggauauccuaacauggaucuggacugccugcucccccaggagugggugcagcauuucuaccaagaagcggcuccugcccagucugauguggcccugcuucgcuuuguuaaucccgacaccggcagaguccuguucgaguguaaacuccacaaguccggguaugugacaguggcucacaccggccagcaugaucuggucaucccgccuaacggauacuuucgguucgacagcugggugaaccaguucuauacgcuugcccccaugggcaaugggaccggaagacgccgguga

SEQ ID NO: 29538 - RNA, 1617 nt, Artificial Sequence
  derived and/or modified sequence opt5 from VP1__Norovirus_and/or_Norovirus-like__JX459600
augaagauggccagcaacgacgcuaaucccuccgauggcucugccgcgcaccuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccgugagcccucggaaugcgcccggagagauucugugguccgccccucuuggcccggaucugaaccccuaccucucucaucuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcacaucauugucgacgugagacaacucgagccugugcugaucccccugccugauguccggaacaauuuuuaucauuacaaccagucuaaugacagcacaauuaagcucaucgccaugcuguauacaccccuucgcgcuaacaacgccggcgaagauguuuucaccguguccugcagagugcugacccggcccagcccugacuuugauuucauuuuucucgucccgcccacaguggagucucgcaccaaaccuuucacgguucccauccugaccguggaagagaugacaaauuccagauuuccuauuccccuugagaagcuguucaccgggccgagcggagccuucgucgugcagccucagaacggccgguguacaaccgacgggguucuccugggaacgacacaacugucucccgugaauaucugcaccuuucgcggcgaugucacacacaucgcuggcuccagaaacuacaccaugaaucucgcgagccugaacuggaauaacuaugacccuaccgaagagauucccgccccucuugggacacccgauuucgugggaaaaauccagggcguccugacgcagaccacaaagggggacggaucuacccggggccauaaggcuacaguguacaccggguccgccccguuuacgccuaaacucggaagcguucaguucuccacagacaccgaaaaugauuuugagacccaccaaaacacaaaguucacccccgugggcgucauucaggacggcucuacaacgcaccgcaaugaaccccagcaaugggugcugccuagcuacuccgggagaaacguucauaaugugcaccuugccccggcugucgcccccaccuuuccuggagagcagcuccuguucuuucggagcacaaugcccggcuguucuggguauccuaacauggaucuggacugccugcucccccaggagugggugcagcauuucuaccaagaagcggcuccugcccaguccgauguggcccugcuucgcuuuguuaaucccgacaccggaagaguccuguucgaguguaaacuccacaagagcggcuaugugacaguggcucacaccgggcagcaugaucuggucaucccgccuaacggcuacuuucgguucgacucuugggugaaccaguucuauacgcuugcccccaugggaaauggcaccgggagacgccgguga

SEQ ID NO: 29539 - RNA, 1617 nt, Artificial Sequence
  derived and/or modified sequence opt5 from VP1__Norovirus_and/or_Norovirus-like__JX459596
augaagauggccagcaacgacgcucaccccuccgauggcucuaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacagugagcccucggaaugcccccggagagauucugugguccgcgccucuuggcccggaucugaaccccuaccucucucaucuggcccgcauguauaauggguacgcuggaggcuucgaaguccagacgauccuugccggcaacgcuuuuaccgccgggaaaauuaucuucgcggccgugccucccaauuuuccuacagagggacugagccccucccagguuaccauguucccgcacaucauuguggacgucagacaacucgagccugugcugaucccccugccugaugugcggaacaauuuuuaucauuacaaccagucuaaugaccccacaauuaagcucaucgcuaugcuguauacaccccuucgcgccaacaacgcuggcgaugacgucuucaccguuagcugcagagugcugacccggccuuccccggauuuugacuucauuuuucucgugcccccuacggucgaaagccgcaccaaacccuucacagugccuauccugaccguugaggaaaugacaaauucuagauuucccauuccgcuugagaagcuguucaccgggccuuccagcgccuucgugguccagccccagaacggacgguguacgacagauggcgugcuccuggggaccacacaacugucuccuguuaauaucugcaccuuucgcggagacgugacccacaucgccggcacacauaacuacacgaugaaucucgcuucccagaacuggaauaacuaugaucccaccgaggaaauuccugcgccccugggcacaccggacuucgucgggagaauccagggaaugcuuacccagacaacccggggcgacgggagcacgcgcggacacaaagccacagugucuaccggcgauguccacuuuaccccuaagcugggguccauucaauucaauacagacaccaacaaugauuuugagacaggacagaacacgaaguucacccccgugggcguugugcaggacggcaaugggacacaucaaaacgaaccccagcaguggguccucccuagcuacuccggaagaaccggccacaaugugcaucuggcuccggccguugcccccacauuuccuggggagcagcuucuguucuuucggucuaccaugcccggauguagcggcuacccuaacaugaaccucgauugccugcugccccaagaaugggugcagcacuucuaucaggaggcugccccugcgcaguccgacgucgcucuccugcgcuuugugaaucccgauacggggagagugcuuuucgaguguaaacugcacaagagcggcuacguuaccgucgcccauacaggacaacacgaccucgugaucccgccuaacggcuauuuucgguucgauucuugggugaaucaguucuacacccuggcccccauggggaacggaacaggcagacgccgguga

SEQ ID NO: 29540 - RNA, 1617 nt, Artificial Sequence
  derived and/or modified sequence opt5 from VP1__Norovirus_and/or_Norovirus-like__JX155749
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagccuggcuaugugacaguggcucauaccgggcagcacgaucuggucauucccccuaacggcuacuuucgguucgacagcugggugaaucaguucuauacgcuugcccccaugggaaacggcaccgggagacgccgguga

SEQ ID NO: 29541 - RNA, 1617 nt, Artificial Sequence
  derived and/or modified sequence opt5 from VP1__Norovirus_and/or_Norovirus-like__JQ613511
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccagcgaccccaccauuaagcucaucgcuaugcuguauacaccccuucgcgccaauaacgcuggagaugacguuuucaccgugucuugcagagugcugacacggccuuccccggauuuugacuucauuuuucucgugcccccuaccgucgaaagccgcacgaaacccuucucuguuccuauccugaccguggaggaaaugacaaacuccagauuucccauuccgcuugagaagcuguucaccggcccuagcucugccuucgucgugcagccccagaaugggcgguguacaaccgauggaguucuccugggcacgacacaacuguccccugugaacaucugcaccuuucgcggggacgucacacauaucgccggaacccaggaguacaccaugaaucucgcuagccagaacuggaauaacuaugaucccacagaagagauuccugcgccccugggcacgccggacuucgugggcaaaauccaggggguccuuacccaaacaaccagacgggacggauccacacgcggccacaaggccaccgugucuacggggagcguucauuuuacaccuaagcugggacggauucaguucuccaccgauaccagcaaugacuuugaaacaggccagaacaccagauucacacccgugggggucgugcaagauggaucuacgacccaccagaaugagccccagcaguggguucucccuaacuacuccggccgcgacagccacaaugugcaucuggcuccggccgucgcccccucuuuuccuggcgaacaacuucuguucuuuagaagcacaaugcccggguguuccggauacccuaacauggaucucgacugccugcugccccaggagugggugcagcacuucuaucaggaggcugccccugcgcaaucugauguggcucuccugcgguuuguuaaucccgacaccggcagaguccuuuucgaauguaaacugcauaagagcggguacgugacaguggcccacaccggacagcacgaucucgucaucccgccuaacggcuauuuucgcuucgacuccugggugaaucaguucuacacgcuggcccccauggggaacggcaccggacggagacgcuga

SEQ ID NO: 29542 - RNA, 1617 nt, Artificial Sequence
  derived and/or modified sequence opt5 from VP1__Norovirus_and/or_Norovirus-like__HM802547
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucaguccaacgacagcacaauuaagcucaucgccaugcuguauacaccccuucgcgcuaauaacgccggcgaugacguuuucaccgugucuugcagagugcugacccggcccuccccugauuuugacuucauuuuucucgucccgcccacaguggaaagccgcaccaaaccuuucacgguucccauccugaccguggaggaaaugacaaacucuagauuuccuauuccccuugagaagcuguucaccgggccguccagcgccuucgucgugcagccucagaauggacgguguacaaccgauggcguucuccuggggacgacacaacugucucccgugaacaucugcaccuuucgcggagacgucacacauaucuccggcagcagaaauuaccggaugaaccucgcuucccagaauuggaacaauuaugauccuaccgaggaaauucccgcgccucugggcacccccgacuucguggggaaaauccagggaaugcuuacacagacgaccaagggcgacgggucuacacgcggacacaaggccaccgucagcacaggcuccguggauuuuaccccgaaacuggggagcguucaauucgcuacggacacagauaacgacuuugagaccggacagaauaccagauucacaccugugggcgucauucaggaugggucuuccgcccaucggaacgaaccccaacagugggugcuccccgacuacagcggccgcaccguucacaaugugcaccuggccccugcugucgccccgacauuucccggagagcagcuucuguucuuuagaucuacgaugccuggcuguagcggguaccccaacauggaucucgacugccugcugccucaggaaugggugcaacauuucuaucaggaggcggcucccucccagucugauguggcccuccugcgguuuguuaauccugacaccggaagaguccuuuucgaguguaagcugcacaaagccggcuacgugacaguggcucauaccgggcagcacgaucucgucauucccccgaacggcuauuuucgcuucgacagcugggugaaucaauucuacacacuggccccuaugggaaacggcgcugggcggagacgcuga

SEQ ID NO: 29543 - RNA, 1617 nt, Artificial Sequence
  derived and/or modified sequence opt5 from VP1__Norovirus_and/or_Norovirus-like__HM802544
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugacagcacaauuaagcucaucgcuaugcuguauacaccccuucgcgccaacaacgcuggcgaugacguuuucaccguguccugcagagugcugacccggcccagcccugauuuugacuucauuuuucucgucccgcccacgguggaaucucgcaccaaaccuuucuccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucgccggcacccagaacuacacaaugaaucucgcuucucagaacuggaauaacuaugauccuacggaggaaauucccgcgccucugggcacccccgacuucguggggaaaauccagggaguccuuacacaaaccacaagacgggacggcuccacccgcgggcacaaggccacggugagcacaggauccguucauuuuaccccgaagcugggcucugugcaguucagcaccgauacauccaaugacuuugagaccgggcagaacacaagauucacgccugucggagugguucaagauggcagcaccacacaccagaaugaaccccagcagugggugcuccccgacuacucuggccgggauucccacaacguccaucuggcuccugccguggccccgaccuuucccggggagcaacuucuguucuuucgcagcacaaugccuggauguucuggcuaccccaauaugaaccucgacugccugcugccucaggaaugggugcagcacuucuaucaggagagcgcucccgcccaauccgauguugcgcuccugagauuugucaauccugacaccgggcgggugcuuuucgaguguaaacugcauaagucuggauacgugacggucgcucacaccggccagcacgaucucgugauucccccgaacggguauuuuagauucgacagcuggguuaaccaguucuacacacuggccccuaugggcaauggagccggccgccggagauga

SEQ ID NO: 29544 - RNA, 1617 nt, Artificial Sequence
  derived and/or modified sequence opt5 from VP1__Norovirus_and/or_Norovirus-like__GQ856456
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucggcgugagacaacucgagccugugcugaucccccugccugacguccggaauaacuuuuaucacuacaaucagucuaacgauagcacaauuaagcucaucgccaugcuguauacaccccuucgcgcuaacaaugccggggaagacguuuucaccguguccugcagagugcugacccggcccagcccugauuuugacuucauuuuucucgucccgcccacaguggagucucgcaccaaaccuuucacgguucccauccugaccguggaagagaugacaaacuccagauuuccuauuccccuugagaagcuguucaccggaccgagcucugccuucgucgugcagccucagaauggccgguguacaaccgaugggguucuccugggaacgacacaacugucccccgugaacaucugcaccuuuaaaggcgacgucacacauaucgcuggcagccgcaauuacaccaugaaccucgcgucucugaauuggaacaauuaugauccuaccgaagagauucccgccccucuugggacacccgacuucgugggaaagauccagggcguccugacgcagaccacaaagggggauggauccaccagaggccacaaagcuacaguguacaccgggagcgccccguuuacgccuaagcucggauccguucaguucucuacagacaccgaaaacgacuuugagacccaucaaaauacaaaauucacccccgugggcgucauucaggauggcgggacaacgcaccggaacgaaccccagcaaugggugcugccuagcuacuccggacgcaauguucagaacgugcaccuugccccggcugucgcccccaccuuuccuggcgagcagcuccuguucuuuagaagcacaaugcccggguguucuggauauccuaauauggaccuggauugccugcucccccaggagugggugcaacauuucuaccaggaagcggcuccugcccaguccgacguggcccugcuucgguuuguuaaccccgauaccggccgcguccuguucgaguguaagcuccacaaaagcggguaugugacaguggcucauaccggccagcacgaccuggucaucccgccuaacggauacuuuagauucgauucuugggugaaucaauucuauacgcuugcccccaugggcaacgggaccggacggagacgcuga

SEQ ID NO: 29545 - RNA, 1617 nt, Artificial Sequence
  derived and/or modified sequence opt5 from VP1__Norovirus_and/or_Norovirus-like__AB541332
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacagggggagccccguuuacgccuaaacucggcuccgcccaguucagcaccgacaccgaaaacgauuuugagacacaucagaauaccaaguucacacccguuggcgugauucaagacgggggaacgacccaccgcaacgaaccccagcaguggguccugccuuccuacucuggcagaaaugugcacaacguucaucuugcuccggccguggcgcccacauuuccuggggagcaacuccuguucuuucggagcaccaugcccggauguuccggcuauccuaauauggaucuggacugccugcucccccaggaguggguccagcacuucuaccaggaagcugccccugcccaaagcgauguggcucugcuucgcuuugugaaccccgacacagggagaguucuguucgaguguaaacuccauaagucuggcuaugucaccguggcccacacgggacagcacgaucuggugaucccgccuaacggcuacuuucgguucgacuccugggucaaucaguucuauacccuugcucccauggggaacggaacaggcagacgccgguga

SEQ ID NO: 29546 - RNA, 1617 nt, Artificial Sequence
  derived and/or modified sequence opt5 from VP1__Norovirus_and/or_Norovirus-like__AB541316
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccauggaccucgcgucucugaacuggaauaacuaugauccuaccgaagagauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgaaaaugacuuugagacccaucaaaacacaaaguucacccccgugggagucauucaggauggcggcacaacgcaccgcaaugaaccccagcaaugggugcugccuagcuacuccgggagaaacguuccgaaugugcaccuugcccccgcugucgccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguggcccugcuucgcuuuguuaauccggauaccggaagaguccuguucgaguguaaacuccacaagagcggcuaugugacaguggcucauaccgggcagcacgaccuggucaucccucccaacggcuacuuucgguucgauucuugggugaaccaguucuauacgcuugccccuaugggaaauggcaccgggagacgccgguga

SEQ ID NO: 29547 - RNA, 1617 nt, Artificial Sequence
  derived and/or modified sequence opt5 from VP1__Norovirus_and/or_Norovirus-like__AB541238
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcgggacaacgcaccgcaacgaaccccagcaaugggugcugccuucuuacagcggaagagauguucacaaugugcaucuugccccggcugucgcccccaccuuuccuggcgagcagcuccuguucuuucgguccacaaugcccggguguagcggauauccuaacauggaccuggauugccugcucccccaggagugggugcagcacuucuaccaagaagcggcuccugcccagucugacguggcccugcuucgcuuuguuaaucccgauaccggcagaguccuguucgaguguaaacuccauaaguccggguaugugacaguggcucacaccggccagcacgaccuggucaucccgccuaacggauacuuucgguucgauagcugggugaaccaguucuauacgcuugcccccaugggcaaugggaccggaagacgccgguga

SEQ ID NO: 29548 - RNA, 1617 nt, Artificial Sequence
  derived and/or modified sequence opt5 from VP1__Norovirus_and/or_Norovirus-like__AB535750
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugggccccagccaggugaccauguucccgcauaucauugucgacgugagacaacucgagccugugcugaucccccugccugauguccggaauaacuuuuaucacuacaaucaguccaacgacucuacaauuaagcucaucgccaugcuguauacaccccuucgcgcuaacaaugccggggaagauguuuucaccgugagcugcagagugcugacccggcccuccccugacuuugauuucauuuuucucgucccgcccacaguggagagccgcaccaaaccuuucacgguucccauccugaccguggaagagaugacaaacucuagauuuccuauuccccuugagaagcuguucaccggaccguccagcgccuucgucgugcagccucagaauggccgguguacaaccgacgggguucuccugggaacgacacaacugucucccgugaacaucugcaccuuucgcggcgaugucacaagaaucgcuggcucccggaauuacaccaugaaccucgcgagccugaauuggaacaauuaugacccuaccgaagagauucccgccccucuugggacacccgauuucgugggaaaaauccagggcguccugacgcagaccacaaagggggacggaucuacccgcggccauaaggcuacaguguacaccggguccgccccguuuacgccuaaacucggaagcguucaguucuccacagacaccgaaaacgauuuugagacccaccaaaauacaaaguucacccccgugggcgucauucaggacggcgggacaacgcauagaaacgaaccccagcaaugggugcugccuucuuacagcggacggaauguuccgaacgugcaccuugcccccgcugucgccccuaccuuucccggcgagcagcuccuguucuuucgcuccacaaugccuggguguagcggauaucccaauauggaucuggacugccugcucccucaggagugggugcagcacuucuaccaagaagcggcucccgcccagucugauguggcccugcuuagauuuguuaacccggacaccggccggguccuguucgaguguaaacuccauaaguccggguaugugacaguggcucacaccggccagcaugaucuggucaucccucccaacggauacuuuagauucgacagcugggugaaucaguucuauacgcuugccccuaugggcaacgggaccggacgccggagauga

SEQ ID NO: 29549 - RNA, 1617 nt, Artificial Sequence
  derived and/or modified sequence opt5 from VP1__Norovirus_and/or_Norovirus-like__FJ538900
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccgcggaagagauuccugcuccccuggggacgccggauuucgugggaagaauccagggcguccuuacccagacaacccgcggggacggauccacacggggccauaaagccaccgugagcacgggggacguucacuuuacaccuaagcugggaucuauucaauucaacaccgauaccaauaacgacuuugaaacaggccagaauaccaaguucacacccgugggcgucgugcaggaugggaacggaacgcaccaaaaugagccccagcaguggguucucccuuccuacagcggcagaaccgggcauaacgugcaccuggccccggccgucgcucccacauuuccuggagaacagcuucuguucuuucgguccaccaugcccggcuguucuggguacccuaacaugaaucucgacugccugcugccccaagagugggugcagcauuucuaucaggaggccgcgccugcucagagcgauguggcccuccugcgcuuuguuaaccccgacacaggcagaguccuuuucgaauguaaacugcacaaguccggauacgugaccguggcccacacgggccaacaugaucucgucaucccgccuaauggguauuuucgguucgacagcugggugaaccaguucuacacccuggcucccaugggaaauggcacagggagacgccgguga

SEQ ID NO: 29550 - RNA, 1617 nt, Artificial Sequence
  derived and/or modified sequence opt5 from VP1__Norovirus_and/or_Norovirus-like__EU876889
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcaaaauccaggggguccuuacccaaacaaccagacgggacggaagcacacgcggccacaaggccaccguguccacggggucuguucauuuuacaccuaagcugggacggauucaguucagcaccgauaccuccaacgacuuugaaacaggccagaauaccagauucacacccgugggggucgugcaagauggaggcacgacccaccagaacgagccccagcaguggguucucccuaauuacagcggccgcgacucucacaacgugcaucuggcuccggccgucgcccccuccuuuccuggggaacaacuucuguucuuuagaagcacaaugcccggauguucuggcuacccuaauaugaaccucgauugccugcugccccaggagugggugcagcacuucuaucaggaggcugccccugcgcaaagcgacguggcucuccugcgguuuguuaaucccgauaccgggagaguccuuuucgaauguaaacugcauaaguccggauacgugacaguggcccacaccggccagcacgaccucgucaucccgccuaacggguauuuucgcuucgauucuugggugaaccaguucuacacgcuggcccccaugggcaauggaaccggccggagacgcuga

SEQ ID NO: 29551 - RNA, 1617 nt, Artificial Sequence
  derived and/or modified sequence opt5 from VP1__Norovirus_and/or_Norovirus-like__EU876887
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcaaaauccaggggguccuuacccaaacaaccagacgggacggaagcacacgcggccacaaggccaccguguccacggggucuguucauuuuacaccuaagcugggacggauucaguucagcaccgauaccuccaacgacuuugaaacaggccagaauaccagauucacacccgugggggucgugcaagauggaagcacgacccaccagaacgagccccagcaguggguucucccuucuuacuccggccgcgacagccacaaugugcaucuggcuccggccgucgcccccucuuuuccuggcgaacaacuucuguucuuuagaagcacaaugcccggguguuccggauacccuaacaugaaucucgauugccugcugccccaggagugggugcagcacuucuaucaggaggcugccccugcgcaaucugacguggcucuccugcgguuuguuaaccccgauaccggcagaguccuuuucgaauguaaacugcauaagagcggguacgugacaguggcccacaccggacagcacgaccucgucaucccgccuaauggcuauuuucgcuucgauuccugggugaaccaguucuacacgcuggcccccauggggaacggcgcuggacggagacgcuga

SEQ ID NO: 29552 - RNA, 1617 nt, Artificial Sequence
  derived and/or modified sequence opt5 from VP1__Norovirus_and/or_Norovirus-like__FJ411171
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaugaucgucgacgugagacaacucgagccugugcugauuccccugccugauguccggaauaacuuuuaucacuacaaucagucuaacgaccccaccaucaagcucauugcuaugcuguauacaccccuucgcgccaacaaugcuggcgaugacguuuucaccgugagcugcagagugcugacacggccuuccccggauuuugacuucaucuuucucgugcccccuaccgucgaaagccgcacgaaacccuucaccguuccuauucugacaguggaggaaaugaccaacucuagauuucccaucccgcuugagcggcuguacacagggccuuccagcgccuucgucgugcagccccagaauggacgcuguaccacggauggcguucuccuggggacaacccaacugucugccgugaacauuugcacauucagaggagacgucacccauaucgcuggcucccggaauuauaccaugaaccucgcgagccagaauuggucuaacuacgauccuacagaggaaauccccgccccucugggcacgcccgacuuuguggggaagauucagggaaugcuuacccagacaacccgcagagacggcuccacacgggggcacaaagcuaccguccugacgggaagcgccgauuucgccccgaagcucggccgcgugcaauuugcuacagacaccgauaaugacuucgaguccggggaaaacaccaaguuuacaccuguuggagugauccaggauggcucuaccacacauagaaaugagccccagcaauggguccugcccaacuacagcggccggacggggcacaaugugcaccuugccccugcgguugcuccgaccuaucccggagaacagcuccuguucuuuagauccacaaugccuggcuguagcggguaccccaacauggaccuggauugccugcucccucaggagugggugcgccauuucuaucaggaggccgcccccgcucaaucugacgucgcccugcuucgguuugugaauccugauaccggaagagugcuguucgaauguaaacuccacaaguccggcuacguuacagucgcucauaccgggcagcacgaccuggugauucccccgaacggcuauuuucgcuucgauagcugggugaaccaguuuuacacgcuugccccuaugggaaauggcgcggggcggagacgcuga

SEQ ID NO: 29553 - RNA, 1617 nt, Artificial Sequence
  derived and/or modified sequence opt5 from VP1__Norovirus_and/or_Norovirus-like__AB447460
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacucuuaugacccuaccgaagagauucccgccccucuugggacacccgauuucgugggaaaaauccagggccugcucacgcagaccacaaagggggacggauccacccggggccacaaggcuacagucuacaccgggagcgccccguuuacgccuaaacugggauccgugcaguucucuacagacaccgaaaaugauuuugagacccaucaaaacacaaaguucacccccguuggcgugauucaggacggcagcacaacgcaccgcaaugaaccccagcaauggguccuuccuuccuacagcgggagaaacgugcacaauguucaucuggccccggcuguggcccccaccuuuccuggagagcagcuccuguucuuucggucuacaaugcccggcuguuccggguauccuaacauggaucuggacugccuccugccccaggaguggguccagcacuucuaccaagaagcggcuccugcccagagcgauguggcccuucugcgcuuugugaaucccgacaccggaagaguucucuucgaguguaaacugcauaagucuggcuaugucacaguggcucacaccgggcagcacgaucuugugaucccgccuaacggcuacuuucgguucgacagcugggucaaccaguucuauacgcuggcccccaugggaaauggcaccgggagacgccgguga

SEQ ID NO: 29554 - RNA, 1617 nt, Artificial Sequence
  derived and/or modified sequence opt5 from VP1__Norovirus_and/or_Norovirus-like__AB447454
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcaccagaaauuacaccaugaaccucgcgucccugaauuggaacaauuaugacccuacagaagagauucccgccccucuugggacgcccgauuucgugggaaaaauccagggcguccugacccagacaaccaagggggacggaagcacacggggccacaaggcuaccguguacacggggucugccccguuuacaccuaaacucggauccguucaguucagcaccgacaccgaaaacgauuuugagacacaucaaaauaccaaguucacacccgugggcgucauucaggacggcgggacgacccaccgcaacgaaccccagcaaugggugcugccuuccuacucuggaagaaauguucacaacgugcaucuugccccggcugucgcccccacauuuccuggcgagcagcuccuguucuuucggagcaccaugcccggguguuccggauauccuaauaugaaccuggauugccugcucccccaggagugggugcagcacuucuaccaagaagcggcuccugcccagagcgacguggcccugcuucgcuuuguuaaccccgauacaggcagaguccuguucgaguguaaacuccauaagucuggguaugugaccguggcucacacgggccagcacgaccuggucaucccgccuaauggauacuuucgguucgauuccugggugaaccaguucuauacccuugcccccaugggcaaugggacaggaagacgccgguga

SEQ ID NO: 29555 - RNA, 1617 nt, Artificial Sequence
  derived and/or modified sequence opt5 from VP1__Norovirus_and/or_Norovirus-like__AB447443
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaggaacuucccgccccucuggggacacccgauuucgugggaaaaauucagggcguccucacgcagaccacaaagggggacggaucuacccggggccacaaggcuacaguguacaccggguccgccccguuuacgccuaaacugggaagcguucaguucuccacagacaccgaaaacgauuuugagacccaucaaaauacaaaguucacccccgugggcgucauccaggacggcucuacaacgcaccgcaacgaaccccagcaaugggugcuuccuagcuacuccgggagaaauguucacaacgugcaucuggccccggcugucgcccccaccuuuccuggagagcagcuccuguucuuucggagcacaaugcccggcuguucuggguauccuaauauggaucuggacugccuccugccccaggagugggugcagcacuucuaccaagaagcggcuccugcccaguccgauguggcccuucugcgcuuuguuaaccccgacaccggaagaguccucuucgaguguaaacugcauaagagcggcuaugugacaguggcucacaccgggcagcacgaucuugucauuccgccuaacggcuacuuucgguucgacucuugggugaaucaguucuauacgcuggcccccaugggaaacggcaccgggagacgccgguga

SEQ ID NO: 29556 - RNA, 1617 nt, Artificial Sequence
  derived and/or modified sequence opt5 from VP1__Norovirus_and/or_Norovirus-like__AB447430
augaagauggccagcaacgacgcuaaucccuccgauggcucuaccgccaaccuggugccugaggucaauaacgaaguuauggcgcucgagccgguggugggggcugccaucgccgcucccgucgccggacagacaaaugugauugacccuuggaucagaaacaauuucguucaagcucccggcggggaauuuacggugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuaccgccgggaaaauuaucuucgcgaagguuccucccaacuuuccuacagagggacugagccccucccaggugaccauguucccgcauaucauugucgacgugagacagcucgagccugugcugaucccccugccugauguccggaauaacuuuuaucacuacaaucaaucuaacgacagcacaauuaaacucaucgccaugcuguauacaccccuucgcgcuaacaaugccggcgaagauguuuucaccguguccugcagagugcugacccggcccagcccugacuuugauuucauuuuucucgucccgcccacgguggagucucgcaccaagccuuucacaguucccauccugaccguggaagagaugacaaacuccagauuuccuauuccccuugagaaacuguucaccgggccgagcggagcuuucgucgugcagccucagaauggccgguguacgacagacgggguucuccugggaaccacacagcugucucccgugaacaucugcaccuuucgcggcgaugucacccauaucgccggcuccagaaauuacacaaugaaccucgccagccugaauuggaacaauuaugacccuacggaagagauucccgcuccucuugggacccccgauuucgugggaaagauccaaggcguccugacacagaccacaaagggggacggaucuacccggggccacaaagcgacgguguacacaggguccgccccguuuaccccuaagcucggaagcguucaguucuccaccgacacagaaaacgauuuugagacccaucagaauacaaaauucacgcccgugggcgucauucaagacggcucuaccacacaccgcaacgaaccccagcagugggugcugccuagcuacuccgggagaaauguucacaacgugcaucuugcuccggccgucgcccccaccuuuccuggagagcaacuccuguucuuucggagcacaaugcccggcuguucuggguauccuaauauggaucuggacugccugcucccccaggagugggugcagcacuucuaccaggaagcugccccugcgcaauccgauguggcucugcuucgcuuuguuaaccccgacaccggaagaguccuguucgaguguaagcuccauaaaagcggcuaugugacgguggcccacaccgggcagcacgaucuggucaucccgccuaacggcuacuuucgguucgacucuugggugaaucaguucuauacacuugcccccaugggaaacggcaccgggagacgccgguga

SEQ ID NO: 29557 - RNA, 1617 nt, Artificial Sequence
  derived and/or modified sequence opt5 from VP1__Norovirus_and/or_Norovirus-like__EU078420
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaauguucacaacgugcaucuugccccggcugucgcccccaccuuuccuggggagcagcuccuguucuuucggucuacaaugcccggauguuccggcuauccuaauauggaucuggacugccugcucccccaggagugggugcagcacuuccaucaagaagcggcuccugcccagagcgauguggcccugcuucgcuuuguuaaccccgacaccgggagaguccuguucgaguguaaacuccacaagucuggauacgugacaguggcucacaccggccagcaugaucuggucaucccgccuaacggguauuuucgguucgacagcugggugaaucaguucuacacgcuugcccccaugggcaacggaaccggcagacgccgguga

SEQ ID NO: 29558 - RNA, 1617 nt, Artificial Sequence
  derived and/or modified sequence opt5 from VP1__Norovirus_and/or_Norovirus-like__AB385637
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcaaaauccaggggguccuuacccaaacaaccagacgggacggaagcacacgcggccacaaggccaccguguccacggggucuguucauuuuacaccuaagcugggacggauucaguucagcaccgauaccuccaacgacuuugaaacaggccagaauaccagauucacacccgugggggucgugcaagauggaagcacgacccaccagaacgagccccagcaguggguucucccuaauuacucuggccgcgacggccacaacgugcaucuggcuccggccgucgcccccuccuuuccuggggaacaacuucuguucuuuagaagcacaaugcccggauguucuggcuacccuaauaugaaccucgauugccugcugccccaggagugggugcagcacuucuaucaggaggcugccccugcgcaaagcgacguggcucuccugcgguuuguuaaucccgauaccgggagaguccuuuucgaauguaaacugcauaaguccggauacgugacaguggcccacaccggccagcacgaccucgucaucccgccuaacggguauuuucgcuucgauucuugggugaaccaguucuacacgcuggcccccaugggcaauggaaccggccggagacgcuga

SEQ ID NO: 29559 - RNA, 1617 nt, Artificial Sequence
  derived and/or modified sequence opt5 from VP1__Norovirus_and/or_Norovirus-like__EF202568
augaagauggccagcaacgacgcuacccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugaccccaccauuaagcucaucgccaugcuguauacaccccuucgcgcuaacaacgccggcgaugacguuuucaccgugagcugcagagugcugacacggccuuccccggauuuugacuucauuuuucucgugcccccuaccgucgaaagccgcacgaaacccuucucuguuccuauccugaccguggaggaaaugacaaauuccagauuucccauuccgcuugagaagcuguucaccgggccuucuagcuccuucgucgugcagccccagaacggacgguguacaaccgauggcguucuccuggggacgacacaacugagcccugugaauaucugcaccuuucgcggagacgucacacauaucgccggcacccagaacuacaccaugaaucucgcuucucagaacuggaauaacuaugaucccacagaggaaauuccugcgccccugggcacgccggacuucguggggaaaauccagggaguccuuacccaaacaaccagacgggacggcuccacacgcgggcacaaggccaccgugagcacgggauccguucauuuuacaccuaagcugggcucugugcaguucagcaccgauaccuccaaugacuuugagacagggcagaacaccagauucacacccgucggagugguucaagauggcagcacgacaccccagaaugaaccucagcagugggugcucccggacuacucuggccgggauucccacaacguccaccuggcucccgccguggccccuaccuuucccggggagcaacuucuguucuuucgcagcaccaugccuggauguucuggcuaccccaauaugaaccucgacugccugcugccucaggaaugggugcagcauuucuaucaggagagcgcucccgcccaauccgauguugcgcuccugagauuugucaauccggacacagggcgggugcuuuucgaguguaaacugcacaagucuggauacgugaccgucgcucauacgggccagcacgaucucgugauuccucccaacggguauuuuagauucgacagcuggguuaaccaguucuacacccuggccccuaugggcaauggagccggccgccggagauga

SEQ ID NO: 29560 - RNA, 1617 nt, Artificial Sequence
  derived and/or modified sequence opt5 from VP1__Norovirus_and/or_Norovirus-like__AB294781
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccugugcugacagucgaagagaugaccaacucuagauuucccaucccgcuugagaagcuguucacagggccuuccggagccuucgugguucagccccagaauggccgguguaccacggacggggugcuccugggaacaacccaacugagcccugucaacauuugcacauuucgcggcgaugugacccauaucgccggcacccacaauuacacaaugaaccucgcuucucagaauuggaacaauuaugaccccacggaagagaucccugcgccccuggggaccccggauuucgucggacggauucagggcaugcuuacacagaccacaaaaggggacggauccaccagaggccauaaggccacggugagcacaggggacguucacuuuaccccuaagcugggaucuauccaauucaacaccgauacaaauaacgacuuugaaaccggccagaauacaaaauucacgcccgugggcgucgugcaggaugggaacggaacccaccaaaaugagccccagcaguggguucucccuuccuacagcggccgcacagggcauaacgugcaccuggcuccggccgucgcccccaccuuuccuggagaacagcuucuguucuuuagauccacaaugcccggcuguucuggguacccuaacaugaaucucgacugccugcugccccaagagugggugcagcauuucuaucaggaggcugccccugcgcagagcgauguggcucuccugcgguuuguuaaccccgacaccggccgcguccuuuucgaauguaagcugcacaaauccggauacgugacgguggcccacaccggccaacaugaucucgucauuccgccuaauggguauuuuagauucgacagcugggugaaccaguucuacacacuggcccccaugggaaauggcaccgggcggagacgcuga

SEQ ID NO: 29561 - RNA, 1617 nt, Artificial Sequence
  derived and/or modified sequence opt5 from VP1__Norovirus_and/or_Norovirus-like__AB303940
augaagauggccagcaacgacgcuacccccuccgauggcucuacagccaaucuggugccugaggucaacacggaaguuauggcgcucgagccgguggugggggcugccaucgccgcucccgucgccggacagcaaaaugugauugacccuuggaucagaaacaauuucguucaggcucccggcggggaauuuaccgugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacagccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcaccaauaacgccggcgaugacguuuucacggugagcugcagagugcugacccggccuuccccggauuuugacuucauuuuucucgugcccccuacagucgaaagccgcaccaaacccuucucuguuccuauccugacaguggaggaaaugaccaacuccagauuucccauuccgcuugagaagcuguucacggggccuagcucugcuuucgucgugcagccccagaauggacgguguacaaccgauggcguucuccuggggacaacccaacuguccccugugaacaucugcaccuuucgcggagacgucacacauaucgccggcacgcagaauuacaccaugaaccucgccagccagaauuggaacaauuaugaucccacagaggaaauuccugcuccccugggcaccccggacuucguggggaaaauccagggaguccuuacacaaaccacgagacgggacggcucuacacgcgggcacaaggcgaccguguccaccggaagcauucauuuuacaccuaagcugggcuccguucaguucucuaccgauacaagcaacgacuuugagacggggcagaauaccagauucacacccgugggagucgugcaagauggcuccaccacacaccagaacgaaccccagcaguggguucucccugacuacagcggccgggauucucacaaugugcaucuggccccggcugucgcccccaccuuuccuggggagcaacuucuguucuuucgcuccacgaugcccggauguagcggcuacccuaacaugaaucucgacugccugcugccccaggaaugggugcagcacuucuaucaggagucugccccugcucaaagcgauguggcccuccugagauuuguuaaccccgacaccgggcggguccuuuucgaguguaaacugcauaaguccggauacgugacaguggcgcacaccggccagcacgaucucgucaucccgccuaauggguauuuuagauucgacucuugggugaaccaguucuacacacuggcucccaugggcaacggagccggccgccggagauga

SEQ ID NO: 29562 - RNA, 1617 nt, Artificial Sequence
  derived and/or modified sequence opt5 from VP1__Norovirus_and/or_Norovirus-like__DQ415279
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcaugucaucguggacgugagacaacucgagccuguccugauuccccugccugauguucggaauaacuuuuaucacuacaaucagucuaacgaccccaccaucaagcucauugcuaugcuguauacaccccuucgcgccaacaaugcuggcgaagauguguucaccgugagcugcagaguccugacacggccuuccccggacuuugauuucaucuuucucgugcccccuaccguugagagccgcacgaaacccuucaccgugccuauucugacagucgaagagaugaccaacucuagauuucccaucccgcuugagaagcuguucacagggccuuccggagccuucgugguucagccccagaauggccgguguaccacggacggggugcuccugggaacaacccaacugagcccugucaacauuugcacauuucgcggcgaugugacccauaucgccggcacccacaauuacacaaugaaccucgcuucucagaauuggaacaauuaugaccccacggaagagaucccugcgccccuggggaccccggauuucgucggacggauucagggcaugcuuacacagaccacaagaggggacggauccacccgcggccauaaagccacggugagcacaggggacguucacuuuaccccuaagcugggaucuauccaauucaacaccgauacaaauaacgacuuugaaaccggccagaauacaaaguucacgcccgugggcgucgugcaggaugggaacggaacccaccaaaaugagccccagcaguggguucucccuuccuacagcggcagaacagggcauaacgugcaccuggcuccggccgucgcccccaccuuuccuggagaacagcuucuguucuuucgguccacaaugcccggcuguucuggguacccuaacaugaaucucgacugccugcugccccaagagugggugcagcauuucuaucaggaggcugccccugcgcagagcgauguggcucuccugcgcuuuguuaaccccgacaccggcagaguccuuuucgaauguaaacugcacaaguccggauacgugacgguggcccacaccggccaacaugaucucgucauuccgccuaauggguauuuucgguucgacagcugggugaaccaguucuacacacuggcccccaugggaaauggcaccgggagacgccgguga

SEQ ID NO: 29563 - RNA, 1617 nt, Artificial Sequence
  derived and/or modified sequence opt5 from VP1__Norovirus_and/or_Norovirus-like__DQ078794
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagaggugcugagccccucccaggucaccauguucccgcauaucauuguggacgugagacaacucgagccuguccugaucccccugccugauguucggaacaaucucuaucacuacaaccagucuaaugaccccacaauucgccugaucgcuaugcuuuauacaccccugagagccaacaacgcuggagaugacguguuuaccgugagcugccggguccucacccgcccuuccccggauuucgacuuuauguuccuggugcccccuacgguugaaagcagaaccaagcccuuuucugugccuauucuuacagucgaggaaaugaccaauucccgguuccccaucccgcuggagaaacucuuuacaggcccuagcucugccuucgugguucagccccagaacgggcgcuguaccacggauggagugcugcugggcacaacccaacucuccccugucaauauuugcacauucagaggggacgugacccauaucgccggagcucagaacuacaccaugaaucuggcgagccagaacuggaauaacuaugaucccacagaggaaaucccugcuccccuuggcacgccggacuuugucggcaagauucagggggugcugacccaaacaacccggcgcgacggaucuacaagaggccacaaagccaccguuuccacggggagcgugcauuucacaccuaagcucggauccguccaguuuucuaccgauaccagcaaugacuucgagacaggccagaacacccgguuuacacccguggggguugugcaagauggauccacgacccaccagaaugaaccccagcaguggguccugccugacuacagcggccgcgauucucacaacgugcaucuugccccggccguggcucccacauucccuggcgagcaacugcucuuuuucagauccaccaugcccggguguagcggauacccuaauaugaaccuggacugccugcucccccaggaauggguucagcacuuuuaucaggagucugccccugcgcaaagcgaugucgcucugcuucgguucgugaaucccgacacaggcagagugcuguuugaguguaagcuccauaaauccggguacgucaccguggcccacacgggacagcacgaucugguuaucccgccuaacggcuauuuccgcuuugacucuuggauuaaccaguucuacacccuugcccccauggggaauggcgcuggacggagacgcuga

SEQ ID NO: 29564 - RNA, 1617 nt, Artificial Sequence
  derived and/or modified sequence opt5 from VP1__Norovirus_and/or_Norovirus-like__KP784691
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccacaacuacacaaugaaucucgcuagccagaacuggaauaacuaugaucccacggaggaaauuccugcgccccugggcaccccggacuucguggggaaaauccagggaguccuuacacagaccacaagaggcgacgggucuacccggggacauaaggccacgguguccacaggcgaugcucacuuuaccccuaagcuggggagcguuauguucuccaccgacacaaauaacgauuuugagaccggacaaaauacacgcuucacgcccgugggcgucgugcaggacggcucuaccacacaccagaacgaaccccaacaguggguucucccuagcuaccuggggagagauucccauaaugugcaccuugccccggccgucgcucccagcuuuccuggagagcagcuccuguucuuucggucuaccaugcccggcuguuccggguacccuaacaugaauauggacugccugcugccccaggaaugggugcaacauuucuaucaggaggccgcgccugcucagagcgauguggcccuccugcgcuuuguuaaccccgacacaggaagaguccuuuucgaguguaaacugcacaagucuggcuacgugaccguggcccacacggggcagcaugaucucgucauuccgccuaacggcuauuuucgguucgacagcugggugaaucaauucuacacccuggcucccaugggaaacggcacagggagacgccgguga

SEQ ID NO: 29565 - RNA, 1617 nt, Artificial Sequence
  derived and/or modified sequence opt5 from VP1__Norovirus_and/or_Norovirus-like__KX907727
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccugugcugacggucgaggaaaugaccaauagcagauuucccaucccgcuugagaagcuguucacagggccuucuuccgccuucgugguucagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaaucccugcgccccugggcacaccggacuucgucgggaaaauucagggaaugcuuacgcagaccacacggaccgacggcagcacacgcgggcacaaggccaucguguacaccggauccgcugauuuugccccuaagcugggcagaguucaauucgagacggacacagaucaugacuuugaagccaaucagaacaccaaauucacccccgugggggucauucaggauggaucuacaacccaccggaaugagccccaacagugggugcucccuagcuacuccggccgcaacacacacaauguucaucuggcuccggccguggcgcccacguuuccuggcgaacagcuucuguucuuuagaagcaccaugcccggguguucuggauauccuaacauggaccucgauugccugcugccccaggaguggguccaauacuucuaucaggaggcugccccugcccaguccgacguggcucuccugcgguuugugaaucccgauacaggcagaguucuuuucgaauguaagcugcacaaaagcggguacgucaccguggcccauacaggacagcacgaccucgugaucccgccuaacggcuauuuucgcuucgauucuugggucaaccaauucuacacccuggcucccauggggaauggcacgggacggagacgcuga

SEQ ID NO: 29566 - RNA, 1617 nt, Artificial Sequence
  derived and/or modified sequence opt5 from VP1__Norovirus_and/or_Norovirus-like__KX354049
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccuauccugacgguggaggaaaugaccaauagcagauuucccauuccgcuugagaagcuguucacagggccuucuuccgccuucgucgugcagccccagaacggacgguguaccacagauggcguucuccuggggaccacgcaacugagcccugugaauaucugcacauuucgcggagacgucacccauaucacaggcucuagaaacuacaccaugaaucucgcuucccagaacuggaauaacuaugaucccaccgaggaaauuccugcgccccugggcacaccggacuucguggggaaaauccagggaguccuuacgcagaccacacgggccgacggcagcacccgcgggcacaaggcuacaguguacaccggauccgccgauuuugccccuaagcugggcagaguucaauucgagacggacacagaucaugacuuugaagcuaaucagaacaccaaauucacccccgugggggucauucaggauggaggcacaacccaccggaaugagccccaacagugggugcucccuucuuacagcggccgcaacacacacaauguucaucuggccccggcgguggcucccacguuuccuggggaacagcuucuguucuuuagauccaccaugcccggauguagcggcuauccuaacauggaccucgauugccugcugccccaggaguggguccaauacuucuaucaggaggccgccccugcucagucugacguggcccuccugcgguuugugaaucccgauacagggagaguucuuuucgaauguaagcugcacaaauccggauacgucaccguggcucauacaggccagcacgaccucgugaucccgccuaacggguauuuucgcuucgauagcugggucaaccaauucuacacccuggcccccaugggcaauggaacgggccggagacgcuga

SEQ ID NO: 29567 - RNA, 1617 nt, Artificial Sequence
  derived and/or modified sequence opt5 from VP1__Norovirus_and/or_Norovirus-like__KX354024
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauacaaccggcucuagaaacuacaccaugaaucucgcuucccagaacuggaauaacuaugaucccacagaggaaaucccugcgccccugggcacgccggacuucguugggaaaauucagggagugcuuacccagacaacccggacagacggcagcacccgcgggcacaaggccacggucuacacaggauccgcugauuuugccccuaagcugggcagagugcaauucgagaccgacaccgaucaugacuuugaagccaaucagaacacaaaauucacccccguuggggugauccaggauggaucuacaacgcaccggaaugagccccaacaguggguccucccuagcuacuccggccgcaacacccacaaugugcaucuggcuccggccguggcgcccacauuuccuggcgaacagcuucuguucuuuagaagcaccaugcccggguguucuggauauccuaacauggaccucgauugccugcugccccaggaguggguucaauacuucuaucaggaggcugccccugcccaguccgacgucgcucuccugcgguuugugaaucccgauacaggcagagugcuuuucgaauguaagcugcacaaaagcggguacgucaccguggcccauacgggacagcacgaccucguuaucccgccuaacggcuauuuucgcuucgauucuugggugaaccaauucuacacccuggcucccauggggaauggcacaggacggagacgcuga

SEQ ID NO: 29568 - RNA, 1617 nt, Artificial Sequence
  derived and/or modified sequence opt5 from VP1__Norovirus_and/or_Norovirus-like__KX353955
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugaggcccaucaaaacaccaaguucacacccgugggcgucauucaggacggcagcaccacacaccgcaaugaaccccagcaaugggugcugccuuccuacagcgggagaaacguucacaaugugcaucuugcuccggccgucgcgcccacguuuccuggagagcagcuccuguucuuucggucuaccaugcccggcuguuccggguauccuaacauggaucuggacugccugcucccccaggagugggugcagcacuucuaccaagaagcugccccugcccagagcgauguggcucugcuucgcuuuguuaaucccgacacaggaagaguccuguucgaguguaaacuccauaagucuggcuaugugaccguggcccacacagggcagcacgaucuggucaucccgccuaacggcuacuuucgguucgacagcugggugaaccaguucuauacccuugcucccaugggaaauggcacggggagacgccgguga

SEQ ID NO: 29569 - RNA, 1617 nt, Artificial Sequence
  derived and/or modified sequence opt5 from VP1__Norovirus_and/or_Norovirus-like__AB972518
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaagcaccacacaucgcaacgagccccaacaguggguccucccuuccuacagcggcagaacgaccccgaaugugcaccuggcucccgccguggcgccuacauuucccggcgaacagcuucuguucuuucggucuaccaugccuggguguuccggauaucccaacauggaccucgauugccugcugccucaggaguggguucaauacuucuaucaggaggcugcccccgcccagagcgacgucgcucuccugagauuugugaauccggauacaggccgcgugcuuuucgaauguaagcugcacaaaucuggguacgucaccguggcccauacgggacagcacgaccucguuauuccucccaacggcuauuuucgguucgauagcugggugaaucaauucuacacccuggcuccuauggggaacggcacaggaagacgccgguga

SEQ ID NO: 29570 - RNA, 1617 nt, Artificial Sequence
  derived and/or modified sequence opt5 from VP1__Norovirus_and/or_Norovirus-like__AB933744
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccacauucgucgugcagccccagaacggacgguguaccacggauggcguucuccuggggacaacccaacugagcccugugaauaucugcacauuucgcggagacgucacccauaucgccggcucuagaaacuacaccaugaaucucgccucccagaacuggaauagcuaugaucccacagaggaaauuccugcuccccugggcacgccggacuucguggggaaaauccagggaguccuuacccagacaacccggacagacggcuccacccgcgggcacaaggcgacgguguacacaggaucugccgauuuuagcccuaagcugggcagaguucaauucgcuaccgacaccgauaacgacuuugaugccaaucagaacacaaaauucacccccgugggggucauucaggacggaggcacagcccaucggaaugagccccaacagugggugcucccuuccuacagcggccgcaacacgcacaauguucaccuggcuccggccguggcgcccaccuuuccuggggaacagcuucuguucuuuagaucuacaaugcccggauguuccggcuauccuaacauggaucucgacugccugcugccccaggaguggguccaauacuucuaucaggaagcugccccugcccagagcgauguggcucuccugcgguuugugaaucccgacaccgggagaguucuuuucgaguguaagcugcauaaaucuggauacgccacagucgcucacaccggccagcaugaucucgugaucccgccuaacggguauuuucgcuucgacagcugggugaaccaauucuacacgcuggcccccaugggcaauggaaccggccggagacgcuga

SEQ ID NO: 29571 - RNA, 1617 nt, Artificial Sequence
  derived and/or modified sequence opt5 from VP1__Norovirus_and/or_Norovirus-like__AB933673
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggcagauuaucuucgccgcuguuccucccaacuuuccuacggagggacugagccccucccaagugaccauguucccgcauaucauugucgacgugagacagcucgagccugugcugaucccccugccugauguccggaauaacuuuuaucacuacaaucagucuaacgacagcacaauuaaacucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaagccuuucacgguucccauccugaccguggaagagaugacaaacuccagauuuccuauuccccuugagaaacuguucaccgggccgagcucugccuucgucgugcagccucaaaauggacgguguacaaccgacggcguucuccuggggacgacacagcugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaagauccagggaguccugacgcagaccacaaaaggcgacggguccacccggggacacaaggcuacaguguacaccggcagcgccccguuuacgccuaagcucggguccguucaauucucuacagacaccgaaaacgauuuugagacccaucagaauacaaaauucacccccgugggagucauucaggacggcggcacaacgcaccgcaacgaaccccaacagugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcaacauuucuaccaggaagcggcucccgcccaguccgauguggcccugcuucgcuuuguuaacccggacaccggaagaguccuguucgaguguaagcuccacaaaagcggcuaugugacaguggcucauaccgggcagcacgaucuggucaucccucccaacggcuacuuucgguucgacucuugggugaaucaauucuauacgcuugccccuaugggaaacggcaccgggagacgccgguga

SEQ ID NO: 29572 - RNA, 1617 nt, Artificial Sequence
  derived and/or modified sequence opt5 from VP1__Norovirus_and/or_Norovirus-like__KM245070
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccgggggagccccguuuacgccuaaacucggcuccguucaguucagcacagacaccgaaaacgauuuugagacccaucaaaauacaaaguucacccccgugggcgucauucaggacggguccacaacgcaccgcaacgaaccccagcaaugggugcugccuucuuacagcggaagaaauguucacaacgugcaucuugccccggcugucgcccccaccuuuccuggcgagcagcuccuguucuuucgguccacaaugcccggguguagcggauauccuaauauggaucuggacugccugcucccccaggagugggugcagcacuucuaccaagaagcggcuccugcccagucugauguggcccugcuucgcuuuguuaaccccgacaccggcagaguccuguucgaguguaaacuccauaaguccggguaugugacaguggcucacaccggccagcacgaucuggucaucccgccuaacggauacuuucgguucgacagcugggugaaucaguucuauacgcuugcccccaugggcaacgggaccggaagacgccgguga

SEQ ID NO: 29573 - RNA, 1617 nt, Artificial Sequence
  derived and/or modified sequence opt5 from VP1__Norovirus_and/or_Norovirus-like__EU921382
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagcucaaugacagcacaauuaagcugaucgccaugcuuuauacaccccugcgcgcuaacaacgccggcgaagauguuuucaccguguccugcagagugcucacccggcccagcccugacuuugauuucauuuuucuggucccgcccacaguggagucucgcaccaaaccuuucacgguucccauccuuaccguggaagagaugacaaauuccagauuuccuauuccccuggagaaacucuucaccgggccgagcggagccuucgucgugcagccucagaacggccgguguacaaccgacgggguucugcugggaacgacacaacucucucccgugaauaucugcaccuuucgcggcgaugucacacauaucgcuggcuccagagacuacaccaugaaccuggcgagccuuaauuggaacaauuaugauccuaccgaagagauucccgccccucuggggacacccgacuucgugggaaagauccagggcguccucacgcagaccacaaagggggacggaucuacccggggccacaaggcuacaguguacaccggguccgccccguuuacgccuaaacugggaagcguucaguucuccacagauaccgaaaacgacuuugagacccaucaaaauacaaaguucacccccgugggcgucauucaggauggcucuacaacgcaccgcaacgaaccccagcaaugggugcuuccuagcuacuccgggagaaauguucacaacgugcaucuggccccggcugucgcccccaccuuuccuggagagcagcuccuguucuuucggagcacaaugcccggcuguucuggguauccuaauauggaccuggauugccuccugccccaggagugggugcagcacuucuaccaagaagcggcuccugcccaguccgacguggcccuucugcgcuuuguuaaccccgauaccggaagaguccucuucgaguguaaacugcauaagagcggcuaugugacaguggcucacaccgggcagcacgaccuugucaucccgccuaauggcuacuuucgguucgauucuugggugaaccaguucuauacgcuggcccccaugggaaacggcaccgggagacgccgguga

SEQ ID NO: 29574 - RNA, 1617 nt, Artificial Sequence
  derived and/or modified sequence opt5 from VP1__Norovirus_and/or_Norovirus-like__KP293589
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggacauuccugcgccccugggcacaccggacuucguugggaaaauccagggagugcuuacgcagaccacacggaccgauggcuccacacgcgggcacaaggccaccgucuacacgggaucugcugacuuugccccuaagcugggcagagugcaauucgaaacagauaccgaccaugauuuugaggccaaccagaauaccaaauucacacccguuggggugauccaggacggaagcaccacacaccggaacgaaccccaacaguggguccucccuuccuacagcggccgcaauacgccgaacgugcaccuggcucccgccguggcgccuaccuuucccggcgagcagcuucuguucuuuagaucuacaaugccuggguguuccggauaucccaauauggaucucgacugccugcugccucaggaauggguucaauacuucuaucaggaggcugcccccgcccagagcgaugucgcucuccugcgguuugugaacccggacaccggcagagugcuuuucgaguguaagcugcauaaaucuggguacgucacaguggcccacaccggacagcaugaucucguuauuccucccaauggcuauuuucgcuucgacagcugggugaaccaauucuacacgcuggcuccuauggggaacggcaccggacggagacgcuga

SEQ ID NO: 29575 - RNA, 1617 nt, Artificial Sequence
  derived and/or modified sequence opt5 from VP1__Norovirus_and/or_Norovirus-like__KP241908
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccaaccacgauuuugaagccaaucagaacaccaaauucacacccguuggggugauccaggacggaagcaccacacacagaaaugagccccaacaguggguccucccuuccuacagcggccggaacacgccgaaugugcaucuggcucccgccguggcgccuaccuuucccggcgaacagcuucuguucuuucgcucuacaaugccuggguguuccggauaucccaacauggaucucgacugccugcugccucaggaguggguucaauacuucuaucaggaggcugcccccgcccagagcgaugucgcucuccugagauuugugaauccggacaccggccgggugcuuuucgaauguaagcugcacaaaucuggguacgucacaguggcccauaccggacagcacgaucucguuauuccucccaacggcuauuuuagauucgacagcugggugaaccaauucuacacgcuggcuccuauggggaauggcaccggacgccggagauga

SEQ ID NO: 29576 - RNA, 1617 nt, Artificial Sequence
  derived and/or modified sequence opt5 from VP1__Norovirus_and/or_Norovirus-like__KJ451059
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucgggacuuugaagccaaucagaacaccaaauucacacccguuggggugauccaggauggauccaccacacaucgcaaugagccccaacaguggguccucccuagcuacucuggcagaaacacgccgaaugugcaccuggcucccgccguggcgccuaccuuucccggcgaacagcuucuguucuuucgguccacaaugccuggguguagcggauaucccaacauggaccucgauugccugcugccucaggaguggguucaauacuucuaucaggaggcugcccccgcccagucugacgucgcucuccugagauuugugaauccggauaccggccgcgugcuuuucgaauguaagcugcacaaaagcggguacgucacaguggcccauaccggacagcacgaccucguuauuccucccaacggcuauuuucgguucgauuccugggugaaucaauucuacacgcuggcuccuauggggaacggcaccggaagacgccgguga

SEQ ID NO: 29577 - RNA, 1617 nt, Artificial Sequence
  derived and/or modified sequence opt5 from VP1__Norovirus_and/or_Norovirus-like__KM198570
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggggcgccccucuugggccggaucugaaccccuaccucucucaccuggcucgcauguauaauggauacgccggcggcuucgaaguccaggugauccuugcugggaacgccuuuacagcgggaaaaauuaucuucgccgcuguuccucccaauuuuccuacggagggccugagccccucccaggugaccauguucccgcauaucauugucgacgugagacaacucgagccugugcugaucccccugccugauguccggaacaauuuuuaucacuacaaccagacaaaugacucuaccauuaagcucaucgccaugcuguauacaccccuucgcgcuaacaacgccggggaagauguuuucaccgugagcugcagagugcugacacggcccuccccugacuuugauuucauuuuucucgucccgcccaccguggagagccgcacgaaaccuuucaccguucccauccugacaguggaagagaugaccaauucuagauuuccuauuccccuugagaagcuguucacaggaccguccggcgccuucgucgugcagccucagaacgggcgguguaccacggacggaguucuccugggcacaacccaacugagccccgugaauaucugcacauuucgcggcgaugucacccauaucgcugggucuagaaacuacaccaugaaucucgcgucccugaacuggaauaacuaugacccuacagaagagauucccgccccucuuggaacgcccgauuucgugggcaaaauccaggggguccugacccagacaaccaagggagacggcagcacacgggggcacaaggcuaccguguacacgggaucugccccguuuacaccuaaacucggcuccguucaguucagcaccgacaccgaaaaugauuuugagacacaucaaaacaccaaguucacacccgugggcgucauucaggacgggggaacgacccaccgcaaugaaccccagcaaugggugcugccuuccuacucuggcagagauguucacaacgugcaucuugccccggcugucgcccccacauuuccuggggagcagcuccuguucuuucggagcaccaugcccggauguuccggcuauccuaauauggaccuggauugccugcucccccaggagugggugcagcacuucuaccaagaagcggcuccugcccagagcgacguggcccugcuucgcuuuguuaaccccgauacagggagaguccuguucgaguguaaacuccauaagucuggcuaugugaccguggcucacaauggacagcacgaccuggucaucccgccuaacggcuacuuucgguucgauuccugggugaaccaguucuauacgcuugcccccauggggaauggaaccggcagacgccgguga

SEQ ID NO: 29578 - RNA, 1617 nt, Artificial Sequence
  derived and/or modified sequence opt5 from VP1__Norovirus_and/or_Norovirus-like__KM198558
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugaccccaccauuaagcucaucgccaugcuguauacaccccuucgcgcuaacaacgccggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaauucuagauuucccauuccgcuugagaagcuguucacagggccuuccggagccuucgucgugcagccccagaacggccgguguaccacggacgggguucuccugggaacaacccaacugagcccugugaauaucugcacauuucgcggcgaugucacccauaucgcuggcucuagagacuacaccaugaaccucgcgucccugaauuggaacaauuaugaucccacagaagagauuccugcuccccuugggacgccggacuucgugggaaaaauccagggcguccugacccagacaacccgcggggacggaagcacacggggccacaaggccaccguguacacggggucugccccuuuugcccccaagcucggauccguucaguucagcacagauaccgaaaacgacuuugagacccaucaaaauacaaaauucacccccgugggcgucauucaggauggcgggacaacgcacagaaacgaaccucagcaaugggugcugccguccuacucuggacgggacguucacaaugugcaucuugcucccgccgucgcgccuaccuuucccggcgagcagcuccuguucuuucgcagcacaaugccuggguguuccggauaucccaacauggaucuggacugccugcucccucaggagugggugcagcacuucuaccaagaagcugcccccgcccagagcgauguggcucugcuuagauuuguuaauccggacaccggccggguccuguucgaguguaagcuccauaaaucuggguaugugacaguggcccacaccggccagcacgaucuggucaucccucccaacggauacuuuagauucgacuccugggugaaucaguucuauacgcuugcuccuaugggcaacgggaccggacgccggagauga

SEQ ID NO: 29579 - RNA, 1617 nt, Artificial Sequence
  derived and/or modified sequence opt5 from VP1__Norovirus_and/or_Norovirus-like__AB447456
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggccugcucacgcagaccacaaagggggacggaucuacccggggccacaaggcuacagucuacaccggguccgccccguuuacgccuaaacugggaagcgugcaguucuccacagacaccgaaaacgauuuugagacccaucaaaauacaaaguucacccccguuggcgugauucaggacggcucuacaacgcaccgcaacgaaccccagcaauggguccuuccuagcuacuccgggagaaaugugcacaacguucaucuggccccggcuguggcccccaccuuuccuggagagcagcuccuguucuuucggagcacaaugcccggcuguucuggguauccuaauauggaucuggacugccuccugccccaggaguggguccagcacuucuaccaagaagcggcuccugcccaguccgauguggcccuucugcgcuuugugaaccccgacaccggaagaguucucuucgaguguaaacugcauaagagcggcuaugucacaguggcucacaccgggcagcacgaucuugugaucccgccuaacggcuacuuucgguucgacucuugggucaaucaguucuauacgcuggcccccaugggaaacggcaccgggagacgccgguga

SEQ ID NO: 29580 - RNA, 1617 nt, Artificial Sequence
  derived and/or modified sequence opt5 from VP1__Norovirus_and/or_Norovirus-like__KF177444
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugaucgacgugagacaacucgagccuguccugauuccccugccugauguucggaauaacuuuuaucacuacaaucaguccaacgaccccacaaucaagcucauugccaugcuguauacaccccuucgcgcuaauaacgccggcgaugacguguucaccgugagcugcagaguccugacccggccuucuccggauuuugacuucaucuuucucgugcccccuacaguugaaucccgcaccaaacccuucagcgugccuguccugacgguggaggaaaugaccaacucuagauuucccauuccgcuugagaagcuguucacagggccuuccagcgccuucguugugcagccccagaauggacgguguaccacagauggcguccuccuggggaccacgcaacugucuccugugaacaucugcacauuucgcggagacgucacccauauuacaggcuccagaaauuacaccaugaaccucgcuagccagaauuggaacaauuaugaucccaccgaggaaaucccugcgccccugggcacaccggacuucguggggaaaauccagggaguucuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauucaggauggaagcaccacacaccggaacgagccccaacagugggugcucccuuccuacagcggccgcaauacgccgaacguccaccuggcucccgccguggcgccuaccuuucccggcgaacagcuucuguucuuuagaucuacaaugccuggguguuccggauaucccaauauggaccucgauugccugcugccucaggagugggugcaauacuucuaucaggaggcugcccccgcccagagcgacguugcucuccugcgguuugucaacccggauaccggcagagugcuuuucgaauguaagcugcauaaaucuggguacgugacagucgcccacaccggacagcaugaccucgugaucccucccaauggcuauuuucgcuucgauagcuggguuaaccaauucuacacgcuggcuccuauggggaacggcaccggacggagacgcuga

SEQ ID NO: 29581 - RNA, 1617 nt, Artificial Sequence
  derived and/or modified sequence opt5 from VP1__Norovirus_and/or_Norovirus-like__KF429776
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccauccugacgguggaggaaaugaccaacagcagauuuccuauuccccuugagaagcuguucacagggccgucuuccaccuucgucgugcagccucagaauggacgguguacaaccgauggcguucuccuggggacgacacaacugagccccgugaacaucugcaccuuucgcggagacgucacacauaucgccggcucuagaaauuacaccaugaaccucgcuucccagaauuggaacagcuaugauccuaccgaggaaauucccgcgccucugggcacacccgacuucguggggaaaauccagggaguccuuacgcagaccacacggaccgacggcuccacacgcgggcacaaggccaccguguacacgggaucugcugauuuuagcccgaagcugggcagaguucaauucgccacagacaccgauaaugacuuugaugccaaccagaauaccaaauucacaccugugggggucauucaggacggaggcaccgcucaucggaacgagccccaacagugggugcuccccuccuacagcggccgcaauacacacaacguucaccuggccccugcgguggcuccgacguuucccggggaacagcuucuguucuuuagaucuaccaugccuggauguuccggcuaucccaauauggaucucgacugccugcugccucaggaguggguccaauacuucuaucaggaagccgcccccgcucagagcgauguggcccuccugcgguuugugaacccugacacagggagaguucuuuucgaguguaagcugcauaaacccggauacgucaccguggcucacacaggccagcaugaucucgugaucccgccuaacggguauuuucgcuucgacucuugggucaaucaauucuacacccuggcccccaugggcaacggaacgggccggagacgcuga

SEQ ID NO: 29582 - RNA, 1617 nt, Artificial Sequence
  derived and/or modified sequence opt5 from VP1__Norovirus_and/or_Norovirus-like__KC243078
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggaggcugccccugcccagucugaagucgcucuccugcgguuugugaaucccgacaccgggagagugcuuuucgaguguaagcugcacaaauccggauacgucacaguggcccauaccggccaguaugaucucguuauuccgccuaacggguacuuucgcuucgacagcugggugaaccaauucuauacgcuggcucccaugggcaauggaaccggccggagacgcuga

SEQ ID NO: 29583 - RNA, 1617 nt, Artificial Sequence
  derived and/or modified sequence opt5 from VP1__Norovirus_and/or_Norovirus-like__KC409280
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaaggaagacgggucuacacggggacacaaggcuaccguguacacgggcuccgccccguuuacaccuaaacucgggagcguucaguucuccaccgacaccgagaaugauuuugaaacacaucaaaacaccaaguucacacccgugggagucauucaggacggcggcacgacccaccgcaaugagccccagcaaugggugcugccuucuuacagcgggagagauguucacaacgugcaucuugccccggcugucgcccccacauuuccuggagagcagauccuguucuuucgguccaccaugcccggcuguagcggguauccuaauauggaccucgauugccugcugccccaggaaugggugcagcacuucuaccaagaggcggcuccugcccagucugacguggcccuccugcgcuuuguuaaccccgauacaggaagaguccuuuucgaauguaaacugcauaaguccggcuaugugaccguggcucacacggggcagcacgaccucgucauuccgccuaauggcuacuuucgguucgauagcugggugaaccaguucuauacccuggcccccaugggaaacggcacagggagacgccgguga

SEQ ID NO: 29584 - RNA, 1617 nt, Artificial Sequence
  derived and/or modified sequence opt5 from VP1__Norovirus_and/or_Norovirus-like__KC175357
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacauggaucuggacugccugcucccucaggagugggugcagcauuucuaccaagaagcggcucccgcccagagcgauguggcccugcuucgcuuuguuaauccggacaccggaagaguccuguucgaguguaaacuccacaagucuggcuaugugacaguggcucauaccgggcagcacgaucuggucaucccucccaacggcuacuuucgguucgacagcugggugaaccaguucuauacgcuugccccuaugggaaauggcaccgggagacgccgguga

SEQ ID NO: 29585 - RNA, 1617 nt, Artificial Sequence
  derived and/or modified sequence opt5 from VP1__Norovirus_and/or_Norovirus-like__JX459621
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcccugugaauaucugcaccuuuagaggagacgucgcccauaucgcuggcacacaggaguacaccaugaaccucgcgucucagaauuggaacaauuaugaucccaccgaagagauuccugcuccccugggcacaccggacuucguggggaagauccagggaguccuuacgcaaaccacacggcgcgacggcuccaccagagggcacaaagccacagugagcaccggauccguucauuuuacgccuaagcugggccggauucaguucucuacagauaccagcaacgacuuugaaaccgggcagaauacacgcuucacccccgugggagucgugcaagauggcggcacaacgcaccagaacgagccccagcaguggguucucccugacuacuccgggagagauagccacaaugugcaucuggccccggccgucgcucccucuuuuccuggagaacaacuucuguucuuucgguccaccaugcccggcuguagcggguacccuaacaugaaucucgacugccugcugccccaggagugggugcagcacuucuaucaggaggccgcgccugcucaaucugauguggcccuccugagauuuguuaaccccgacacaggacgcguccuuuucgaauguaagcugcauaaaagcggcuacgugaccguggcccacacagggcagcacgaucucgucaucccgccuaauggcuauuuucgguucgacuccugggugaaccaguucuacacccuggcucccaugggaaacggcacggggagacgccgguga

SEQ ID NO: 29586 - RNA, 1617 nt, Artificial Sequence
  derived and/or modified sequence opt5 from VP1__Norovirus_and/or_Norovirus-like__JQ613541
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuguuuucgcgguggucccucccaauuuuccuaccgagggacugucccccucucaggugacaauguucccgcauaucaucguggacgucagacaacucgagccuguucugauuccccugccugaugugcggaacaauuuuuaucacuacaaccagagcaaugaccccaccaucaagcucauugccaugcuguauacaccccuucgcgcuaacaacgccggcgaugacguguucaccgucuccugcagagugcugacacggccuagcccggauuuugacuucaucuuucucguucccccuaccguggaaucucgcacgaaacccuucuccgucccuauucugaccguggaggaaaugacaaauagcagauuucccaucccgcuugagaagcuguucaccgggccuucuuccgcuuucguugugcagccccagaacggacgguguacaaccgauggcguccuccuggggacgacacaacugagcccugugaauauuugcaccuuucgcggagacgucacacauaucgccggcucucacaacuacaccaugaaucucgccucccagaacuggaauagcuaugaucccaccgaggaaaucccugcuccccugggcacaccggacuucguggggaaaauucagggaguucuuacgcagaccacaagaaccgacggcuccacacgggggcauaaggcgaccguguacacgggaucugccgaguuuagcccuaagcugggccgcguccaauucgcuacagauaccaacaaugacuuugaugccaaccagaauaccaaauucacacccguggggguuauccaggacggaggcaccacacacagaaacgaaccccaacagugggugcucccuuccuacagcggccggaauacgcacaacguccaucuggccccggcuguggcccccaccuuuccuggggagcagcuucuguucuuucgcucuacaaugcccggauguuccggcuauccuaauauggaucucgacugccugcugccccaggaaugggugcaauacuucuaucaggaggcggcuccugcccagagcgauguugcccuccugagauuugucaaccccgacaccgggcgggugcuuuucgaguguaagcugcacaaaucuggauacgugacagucgcucauauuggccagcacgaucucgugaucccgccuaacggguauuuuagauucgacagcuggguuaaucaauucuacacccuggcccccaugggcaacggaacgggccgccggagauga

SEQ ID NO: 29587 - RNA, 1617 nt, Artificial Sequence
  derived and/or modified sequence opt5 from VP1__Norovirus_and/or_Norovirus-like__JQ613527
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggguuagaaauaacuucgugcaggcucccggcggggaauuuacagucuccccucggaaugcccccggagagauccuguggucugcgccucuuggcccggaucugaaccccuaccucagccaccuggcccgcauguauaauggguacgcuggaggcuucgaagugcagguuauucuugccggcaacgcuuuuacggccgggaaaaucauuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuauucugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucgccggcucucacaacuacaccaugaaucucgcuucccagaacuggaauagcuaugaucccaccgaggaaaucccugcgccccugggcacaccggacuucgucgggaaaauucagggagugcuuacgcagaccacaagaaccgacggcuccacacgggggcauaaggccaccguuuacacgggaucuacagaguuuagcccuaagcugggccgcgugcaauucgcuaccgauaccaacaaugacuuugaugccaaccagaauacaaaauucacccccgucggggugauccaggacggaggcacaacgcacagaaacgaaccccaacaguggguucucccuuccuacagcggccggaauacccacaacgugcaucuggccccggcugucgcccccacauuuccuggggagcagcuucuguucuuucgcucuaccaugcccggauguuccggcuauccuaauauggaucucgacugccugcugccccaggaaugggugcaauacuucuaucaggaggcggcuccugcccagagcgauguggcccuccugagauuuguuaaccccgacacagggcggguccuuuucgaguguaagcugcacaaaucuggauacgugaccguggcucauacgggccagcacgaucucgucauuccgccuaacggguauuuuagauucgacagcugggugaaucaauucuacacccuggcccccaugggcaacggaacaggccgccggagauga

SEQ ID NO: 29588 - RNA, 1617 nt, Artificial Sequence
  derived and/or modified sequence opt5 from VP1__Norovirus_and/or_Norovirus-like__JF827296
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacguuuuuaccgcugggaaaauuaucuucgccgcggugccucccaauuuuccuacagagggacugagccccucccaggucaccauguucccgcauaucauuguggacgugagacaacucgagccuguccugaucccccugccugauguucggaacaauuuuuaucacuacaaccagucuaaugaccccacaauuaagcucaucgccaugcuguauacaccccuucgcgcuaacaacgccggcgaugacguguucaccgugagcugcagaguccugacccggccuuccccggauuuugacuucauuuuucucgcucccccuacgguggaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccauucaguucucuaccgauacaagcaaugacuuugagaccgggcagaacacaagauucacgcccgugggagucgugcaagauggcuccaccacacaccagaaugaaccccagcaguggguucucccugacuacagcggccgggauucucacaacgugcaucuggcuccggccgucgcccccaccuuuccuggggagcaacuucuguucuuucgcuccacaaugcccggauguagcggcuacccuaauaugaaccucgacugccugcugccccaggaaugggugcagcacuucuaucaggagucugcuccugcccaaagcgauguggcgcuccugagauuuguuaaucccgacaccgggcggguccuuuucgaguguaaacugcauaaguccggauacgugacgguggcucacaccggccagcacgaucucgucaucccgccuaacggguauuuuagauucgacucuugggugaaccaguucuacacacuggcccccaugggcaauggagccggccgccggagauga

SEQ ID NO: 29589 - RNA, 1617 nt, Artificial Sequence
  derived and/or modified sequence opt5 from VP1__Norovirus_and/or_Norovirus-like__JF713050
augaagauggccagcaacgacgcuaaucccuccgauggcucugccgcgaaccuggugccugaggucaauaacgaaguuauggcucucgagccgguggccggggccgcucuggccgcucccguggccggacagcaaaaugucaucgacccuuggauuagaaacaauuucgugcaggcgcccggcggggaauuuaccguuagcccucggaacgcccccggagagauccuuugguccgcuccucugucuccggaucucaaucccuaccugagccaccuugcccgcauguauaacuccuacgcuggcggguucgaagugcaggucauucuggccggaaaugcguuuacagccggcaaaaucauuuucgcugccgugccucccaacuuuccuaucgagggccucucucccagccagguuacgauguucccgcauaucauuguggacgucagacaacuggagccugugcugaucccccucccugaugugcggaauaacuuuuaucacuacaaucaguccaacgaacccaccauuaagcugaucgcuaugcuuuauacaccccugcgcgccaacaaugccggggaggacgucuucaccguuagcugcagagugcucacacggccuucuccggauuuugacuucauuuuucuggugcccccuaccgucgaaucccgcacaaaacccuucaccgugccuauccuuacgguugaggagaugaccaacagcagauuucccauuccgcuggaaaagcuguucacaggaccuucuuccagcuucgugguccagccccagaauggccgguguaccacagauggggugcugcugggaaccacgcaacucucuccuguuaacaucugcacauuucgcggcgacgugacccauaucgcuggguccagaaauuacacaaugaaccuggcgagcauuaauuggaacaauuaugaucccaccgaggaaaucccugcuccccuuggaaccccggacuucgucggcaaaauucagggcaugcugacacagacgacccgcggggauggauccacacggggccacagagccaccguguacacagggucugccccuuuuacccccaagcucggaagcguccaguucacgacagacaccgacaacgauuuugagaccaaucaaaacacaaaguucacccccgugggcguugugcaggacggggauacagcccaucggaaugaaccucagcaauggguccugccguccuacagcggacgcaacgugcagaauguucaccuugcucccgccguggcgccuacguuucccggcgagcagcuccucuucuuuagaucuaccaugccuggcuguuccggguaucccaacauggaccuggauugccugcucccucaggaguggguccaacacuucuaccaggaagcugcccccgcccagagcgacguggcucugcuucgguuugugaacccggauacaggaagaguucuguucgaguguaaacuccauaagucuggcuaugucaccguggcccacacagggcagcaugaccuggugaucccucccaauggauacuuucgcuucgauagcugggucaaccaauucuauacccuugcuccuaugggcaaugggacgggccggagacgcuga

SEQ ID NO: 29590 - RNA, 1617 nt, Artificial Sequence
  derived and/or modified sequence opt5 from VP1__Norovirus_and/or_Norovirus-like__HM802548
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaucuuaccggaugaaccucgccucccagaauuggaacaauuaugaucccacagaggaaauuccugcuccccugggcacgccggacuucguggggaaaauccagggaaugcuuacccagacaaccaagcgcgacggcagcacaagagggcacaaggcgaccgucuccacgggaucuguggauuuuacaccuaaacugggcagcguucaauucgccaccgacaccgauaacgacuuugagacagggcagaauacccgguucacacccgugggagucauucaggauggcuccagcacgcaucgcaacgaaccccaacagugggugcucccugacuacucuggcagaaccguucacaaugugcaccuggcuccggccgucgcccccacauuuccuggggagcagcuucuguucuuucgguccaccaugcccggauguagcggcuacccuaacauggaucucgacugccugcugccccaggaaugggugcaacauuucuaucaggaggcugccccuucucagagcgauguggcgcuccugagauuuguuaaucccgacacagggcgcguccuuuucgaguguaagcugcacaaagcuggauacgugaccguggcccauacgggccagcacgaucucgucaucccgccuaacggguauuuucgguucgacuccugggugaaucaauucuacacccuggcccccaugggcaacggagcuggcagacgccgguga

SEQ ID NO: 29591 - RNA, 1617 nt, Artificial Sequence
  derived and/or modified sequence opt5 from VP1__Norovirus_and/or_Norovirus-like__GQ856459
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccagaugauccuugcuggcaaugccuuuacagcggggaaaauuaucuucgccgcugugccucccaacuuuccuacggagggacugagccccucccagguuaccauguucccgcauaucauuguggacgucagacaacucgagccugugcugaucccccugccugaugugcggaauaacuuuuaucacuacaaucagucuaacgacagcacaauuaagcucaucgccaugcuguauacaccccuucgcgcuaacaaugccggcgaagaugucuucaccguuuccugcagagugcugacccggcccagcccugacuuugauuucauuuuucucgugccgcccacagucgagucucgcaccaaaccuuucacggugcccauccugaccguugaagagaugacaaacuccagauuuccuauuccccuugagaagcuguucaccgggccgagcucugccuucgugguccagccucagaauggacgguguacaaccgacggcgugcuccuggggacgacacaacugucccccguuaacaucugcaccuuucgcggagaugugacacauaucgcuggcagcagaaauuacaccaugaaccucgcgucucugaauuggaacaauuaugacccuaccgaagagauucccgccccucuuggcacacccgauuucgucgggaaaauccagggagugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcggcacaacgcaccgcaacgaaccccagcaauggguccugccuagcuacuccgggagaaaugugccgaacguucaccuugcccccgcuguggccccuaccuuucccggagagcagcuccuguucuuucggagcacaaugccuggcuguucuggguaucccaauauggaucuggacugccugcucccucaggaguggguccagcauuucuaccaagaagcggcucccgcccaguccgauguggcccugcuucgcuuugugaacccggacaccggaagaguucuguucgaguguaaacuccacaagagcggcuaugucacaguggcucauaccgggcagcacggccuggugaucccucccaacggauacuuucgguucgauucuugggucaaucaguucuauacgcuugccccuaugggcaacgggaccggaagacgccgguga

SEQ ID NO: 29592 - RNA, 1617 nt, Artificial Sequence
  derived and/or modified sequence opt5 from VP1__Norovirus_and/or_Norovirus-like__AB541308
augaagauggccagcaacgacgcuaaucccuccgauggcucugccgcgaaccuggugccugaggucaauaacgaaguuauggcucucgacccgguggugggggccgccaucgcugcccccgucgcuggacagcaaaaugugauugauccuuggaucagaaacaauuucguucaggcccccggcggggaguuuaccgugagcccucggaacgcgcccggagaaauucugugguccgccccucuuggcccggaccugaaucccuaccucucucaccuggcucgcauguauaacggguacgccggaggcuucgagguccaggugauccuugcuggcaaugccuuuacagcggggaaaauuaucuucgccgcuguuccucccaacuuuccuacggaaggacugagccccucccaggugaccauguucccgcauaucauugucgaugugagacaacucgagccugugcugaucccccugccugacguccggaauaacuuuuaucacuacaaucagucuaacgauagcacaauuaagcucaucgccaugcuguauacaccccuucgcgcuaacaaugccggcgaggacguuuucaccguguccugcagagugcugacccggcccagcccugauuuugacuucauuugucucgucccgcccacaguggaaucucgcaccaaaccuuuuacgguucccauccugaccguggaggaaaugacaaacuccagauucccuauuccccuugagaagcuguuuaccgggccgagcucugccuucgucgugcagccucagaauggacggugcacaaccgauggcguucuccuggggacgacacaacugucccccgugaacaucuguaccuuccgcggagacgucacacauaucgcuggcagcagaaauuacaccaugaaccucgcgucucugaauuggaacaauuaugauccuaccgaggaaauucccgccccucuuggcacacccgacuuuguggggaaaauccagggaguccugacgcagaccacaaagggcgacggguccacccggggacacaaggcuacaguguacaccggcagcgccccguucacgccuaaacucggguccguucaguuuucuacagauaccgagaacgacuucgaaacccaucaaaauacaaaguuuacccccgugggagucauucaggauggcggcacaacgcaccgcaacgagccccagcaaugggugcugccuagcuacuccgggagaaauguuccgaacgugcaccuugcccccgcugucgccccuaccuuccccggagaacagcugcucuuuuuccggagcacaaugccuggcugcucuggguaucccaauauggaccuggauugucugcucccucaggagugggugcagcauuuuuaccaagaggcggcucccgcccaguccgacguggcccugcuucgcuucguuaacccggauaccggaagaguccuguuugaaugcaaacuccacaagagcggcuaugugacaguggcucauaccgggcagcacgaccuggucaucccucccaacggcuacuuccgguuugauucuugggugaaucaguucuauacgcuugccccuaugggaaacggcaccgggagacgccgguga

SEQ ID NO: 29593 - RNA, 1617 nt, Artificial Sequence
  derived and/or modified sequence opt5 from VP1__Norovirus_and/or_Norovirus-like__AB541276
augaagauggccagcaacgacgcuaaucccuccgauggcucugccgcgagccuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucaguccaacgacagcacaauuaagcucaucgccaugcuguauacaccccuucgcgcuaauaacgccggcgaagauguuuucaccgugucuugcagagugcugacccggcccuccccugacuuugauuucauuuuucucgucccgcccacaguggagagccgcaccaaaccuuucacgguucccauccugaccguggaagagaugacaaacucuagauuuccuauuccccuugagaagcuguucaccgggccguccggagccuucgucgugcagccucagaauggccgguguacaaccgacgggguucuccugggaacgacacaacugagccccgugaacaucugcaccuuucgcggcgaugucacacauaucgcuggcucuagaaauuacaccaugaaccucgcgucccugaauuggaacaauuaugacccuaccgaagagauucccgccccucuugggacacccgauuucgugggaaaaauccagggcguccugacgcagaccacaaagggggacggaagcacccggggccacaaggcuacaguguacaccggguccgccccguuuacgccuaaacucggaucuguucaguucagcacagacaccgaaaacgauuuugagacccaucaaaauacaaaguucacccccgugggcgucauucaggacggcuccacaacgcaccgcaacgaaccccagcaaugggugcugccuagcuacucugggagagauguucacaaugugcaucuugccccggcugucgcccccaccuuuccuggagagcagcuccuguucuuucgguccacaaugcccggcuguagcggguauccuaacauggaccuggauugccugcucccccaggagugggugcagcacuucuaccaagaagcggcuccugcccagucugacguggcccugcuucgcuuuguuaaucccgauaccggaagaguccuguucgaguguaaacuccauaagagcggcuaugugacaguggcucacaccgggcagcacgaccuggucaucccgccuaacggcuacuuucgguucgauuccugggugaaucaguucuauacgcuugcccccaugggaaacggcaccgggagacgccgguga

SEQ ID NO: 29594 - RNA, 1617 nt, Artificial Sequence
  derived and/or modified sequence opt5 from VP1__Norovirus_and/or_Norovirus-like__AB541224
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacauggaucuggacugccugcucccucaggagugggugcagcauuucuaccaagaagcggcucccgcccagagcgauguggcccugcuucgcuuuguuaauccggacaccggaagaguccuguucgaguguaaacuccacaagucuggcuaugugacaguggcucauaccgggcagcacgaucuggucaucccucccaacggcuacuuucgguucgacagcugggugaaccaguucuauacgcuugccccuaugggaaauggcaccgggagacgccgguga

SEQ ID NO: 29595 - RNA, 1617 nt, Artificial Sequence
  derived and/or modified sequence opt5 from VP1__Norovirus_and/or_Norovirus-like__AB504330
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugaucgacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuucuuauuccucuggagaaacucuucacagggcccagcggagccuucgucgugcagccgcagaauggccgguguaccacggacgggguucugcugggaacaacccagcucucuccugugaacaucugcacauuucgcggcgaugucacccauaucgcuggcuccagaaauuacaccaugaaccuggcgagccuuaauuggaacaauuaugaccccacagaagagauuccugcuccccuggggacgccugauuucgugggaaagauccaaggcguccucacccagacaaccaagggggacggaucuacacggggccacaaggccaccguguacacgggguccgcccccuuuacaccgaaacugggaagcguucaguucuccaccgacaccgaaaacgauuuugagacacaucagaauaccaaguucacaccugugggcgucauucaagacggcucuacgacccaccgcaacgaaccccagcagugggugcuucccagcuacuccgggagaaauguucacaacgugcaucuggccccugcugucgccccgacauuucccggagagcaacuccuguucuuucggagcaccaugccuggcuguucuggguaucccaauauggaucuggacugccuccugccucaggagugggugcagcacuucuaccaggaagcggcucccgcccaauccgauguggcccuucugcgcuuuguuaacccugacacaggaagaguccucuucgaguguaaacugcauaagagcggcuaugugaccguggcucacacggggcagcacgaucuugucauucccccgaacggcuacuuucgguucgacucuugggugaaucaguucuauacccuggccccuaugggaaacggcacagggagacgccgguga

SEQ ID NO: 29596 - RNA, 1617 nt, Artificial Sequence
  derived and/or modified sequence opt5 from VP1__Norovirus_and/or_Norovirus-like__AB447445
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggacggacugagccccucccaggugaccauguucccgcauaucauugucgaugugagacaacucgagccugugcugaucccccugccugacguccggaauaacuuuuaucacuacaaucagucuaacgauagcacaauuaagcucaucgccaugcuguauacaccccuucgcgcuaacaaugccggcgaggacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgagaacgacuuugaaacccaucaaaauacaaaguucacccccgugggagucauucaggauggcggcacaacgcaccgcaacgagccccagcaaugggugcugccuagcuacuccgggagaaauguucacaacgugcaucuugccccggcugucgcccccaccuuuccuggagaacagcuccuguucuuucggagcacaaugcccggcuguucuggguauccuaauauggaccuggauugccugcucccccaggagugggugcagcacuucuaccaagaggcggcuccugcccaguccgacguggcccugcuucgcuuuguuaaccccgauaccggaagaguccuguucgaauguaaacuccauaagagcggcuaugugacaguggcucacaccgggcagcacgaccuggucaucccgccuaacggcuacuuucgguucgauucuugggugaaucaguucuauacgcuugcccccaugggaaacggcaccgggagacgccgguga

SEQ ID NO: 29597 - RNA, 1617 nt, Artificial Sequence
  derived and/or modified sequence opt5 from VP1__Norovirus_and/or_Norovirus-like__AB294793
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcaugcugacgcagaccacaaagggggacggaucuacccggggccacaaggcuacagucuacaccggguccgccccguuuacgccuaaacucggaagcgugcaguucuccacagacaccgaaaacgauuuugagacccaucaaaauacaaaguucacccccguuggcgugauucaggacggcucuacaacgcaccgcaacgaaccccagcaauggguccugccuagcuacuccgggagaaaugugcacaacguucaucuugccccggcuguggcccccaccuuuccuggagagcagcuccuguucuuucggagcacaaugcccggcuguucuggguauccuaauauggaucuggacugccugcucccccaggaguggguccagcacuucuaccaagaagcggcuccugcccaguccgauguggcccugcuucgcuuugugaaccccgacaccggaagaguucuguucgaguguaaacuccauaagagcggcuaugucacaguggcucacaccgggcagcacgaucuggugaucccgccuaacggcuacuuucgguucgacucuugggucaaucaguucuauacgcuugcccccaugggaaacggcaccgggagacgccgguga

SEQ ID NO: 29598 - RNA, 1617 nt, Artificial Sequence
  derived and/or modified sequence opt5 from VP1__Norovirus_and/or_Norovirus-like__AB303934
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaaaguucacgcccguuggcgugauccaggaugggaacggagcucaccaaaaugagccccagcaguggguccucccuuccuacagcggcagaaccgggcauaacgugcaccuggccccggccguugcucccacauuuccuggagaacagcuucuguucuuucgguccaccaugcccggcuguucuggguacccuaacaugaaucucgacugccugcugccccaagagugggugcagcauuucuaucaggaggccgcgccugcucagagcgaugucgcccuccugcgcuuugugaaccccgacacaggcagagugcuuuucgaauguaaacugcacaaguccggauacauuaccguugcccacacgggccaacaugaucucgucaucccgccuaauggguauuuucgguucgacagcugggugaaccaguucuacacccuggcucccaugggaaauggcacagggagacgccgguga

SEQ ID NO: 29599 - RNA, 1617 nt, Artificial Sequence
  derived and/or modified sequence opt5 from VP1__Norovirus_and/or_Norovirus-like__KU678205
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaagugcagggaguccuuacgcagaccacaagaaccgacggcuccacacgggggcauaaggccaccguguacacgggaucugcugauuuugccccuaagcugggccgcguucaauucgagacagacaccaaccacgauuuugaagccaaucagaacaccaaauucacacccgugggggucauccaggacggaggcaccacacacagaaaugagccccaacagugggugcucccuagcuacuccggccggaacacgccgaaugugcaucuggcucccgccguugcgccuaccuuucccggggaacagcuucuguucuuucgcagcacaaugccuggauguucuggcuaucccaacauggaucucgacugccugcugccucaggaguggguccaauacuucuaucaggaggcugcccccgcccaguccgauguggcucuccugagauuugugaauccggacaccgggcggguccuuuucgaauguaagcugcacaaaagcggauacgugacaguugcccauaccggccagcacgaucucgugaucccucccaacggguauuuuagauucgacucuugggucaaccaauucuacacgcuggcuccuaugggcaauggaaccggccgccggagauga

SEQ ID NO: 29600 - RNA, 1617 nt, Artificial Sequence
  derived and/or modified sequence opt5 from VP1__Norovirus_and/or_Norovirus-like__LC177657
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggaaugcuuacgcagaccacacggaccgacggcagcacacgcgggcacaaggccaccguguacacgggauccgcugauuuugccccuaagcugggcagaguccaauucgagacagacaccgaucgggacuuugaagccaaucagaacaccaaauucacacccguggggguuauccaggauggaucuaccacacaucgcaaugagccccaacagugggugcucccuagcuacuccggcagaaacacgccgaauguccaccuggcucccgccguggcgccuaccuuucccggcgaacagcuucuguucuuucggagcacaaugccuggguguucuggauaucccaacauggaccucgauugccugcugccucaggagugggugcaauacuucuaucaggaggcugcccccgcccaguccgacguugcucucgucagauuugugaauccggauaccggccgcgugcuguucgaauguaaacuucacaagagcggguacgucacaguggcccauaccggacagcacgaccugguuauuccucccaacggcuauuuucgguucgauucuugggugaaccaauucuacacgcucgcuccuauggggaauggcaccggaagacgccgguga

SEQ ID NO: 29601 - RNA, 1617 nt, Artificial Sequence
  derived and/or modified sequence opt5 from VP1__Norovirus_and/or_Norovirus-like__LC177656
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauacaaccggcucucacaacuacaccaugaaucucgcuucccagaacuggagcaauuaugaucccacagaggaaaucccugcgccccugggcacgccggacuucguugggaaaauucagggagugcuuacccagacaaccagaaucgacggcuccacacgggggcauaaggccaccgucuacacgggaucugcugauuuugccccuaagcugggccgcgugcaauucgagacagacaccgaucacgacuuugaagccaaccagagcaccaaauucacacccguuggggugauccaggauggauccaccacacacagaaaugagccccaacaguggguccucccuagcuacucuggccggaacacgccgaaugugcaucuggcucccgccguggcgccuaccuuucccggcgaacagcuucuguucuuucgcuccacaaugccuggguguagcggauaucccaacauggaccucgauugccugcugccucaggaguggguucaauacuucuaucaggaggcugcccccgcccagucugacgucgcucuccugagauuugugaauccggauaccggccgggugcuuuucgaauguaagcugcacaaaagcggguacgucacaguggcccauaccggacagcacgaccucguuauuccucccaacggcuauuuuagauucgauuccugggugaaucaauucuacacgcuggcuccuauggggaacggcaccggacgccggagauga

SEQ ID NO: 29602 - RNA, 1617 nt, Artificial Sequence
  derived and/or modified sequence opt5 from VP1__Norovirus_and/or_Norovirus-like__KX354136
augaagauggccagcuccgacgcuaaccccucugauggcagcgccgcgaaucuggugccugaggucuccaacgaaguuauggcucucgagccgguggugggggccgccaucgcugcccccgucgcuggacagcaaaauauuaucgacccuuggauuagaaacaauuucgugcaggcccccggcggggaauuuaccguuucuccucggaacgcgcccggagagauccuguggagcgccccucuuggcccggaucugaaucccuaccucucccaccuggcucgcauguauaacggguacgccggaggcuucgaagugcaggucauucuugcuggcaaugccuuuacagcggggaaaaucaucuucgccgcugugccucccaacuuuccuacggagggacugucucccagccagguuaccauguucccgcauauuaucguggacgucagacaacucgagccugugcugauuccccugccugaugugcggaauaacuuuuaucacuacaaucaguccaacgaccccacaaucaagcucauugccaugcuguauacaccccuucgcgcuaauaacgccggcgaugacgucuucaccguuagcugcagagugcugacccggccuucuccggauuuugacuucaucuuucucgugcccccuacagucgaaucccgcaccaaacccuucagcgugccuauucugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccuguuaacaucugcacauuucgcggagacgugacccauauuacaggcucccacaauuacaccaugaaccucgcuagccagaauuggaacaauuaugaucccaccgaggaaaucccugcgccccugggcacaccggacuucgucgggaaaauucagggagugcuuacgcagaccacaagauccgacggcucuacccgggggcauaaggccacagucuacaccggaagcgcugauuuugccccuaagcugggccgcgugcaauucgagacggacacagauagagacuuugaaaccaaccagaauaccaaauucacacccguuggggugauccaggauggaaccacagcccaccggaacgagccccaacaguggguccucccuuccuacagcggccgcaauauucacaacgugcaucuggcuccggccguugcgcccacguuuccuggcgaacagcuucuguucuuuagaucuaccaugcccggguguuccggauauccuaauauggaccucgauugccugcugccccaggagugggugcaauacuucuaucaggaggcugccccugcccagagcgacgucgcucuccugcgguuugugaaccccgauacaggcagagugcuuuucgaauguaagcugcacaaaucuggguacguuaccgucgcccauacaggacagcacgaccucgugaucccgccuaauggcuauuuucgcuucgauagcugggugaaccaauucuacacccuggcucccauggggaacggcacgggacggagacgcuga

SEQ ID NO: 29603 - RNA, 1617 nt, Artificial Sequence
  derived and/or modified sequence opt5 from VP1__Norovirus_and/or_Norovirus-like__KX354121
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagcggcuguucacagggccuucuuccgccuucgugguccagccccagaacggacgcuguaccacagauggcgugcuccuggggaccacgcaacugagcccugucaauauuugcacauuuagaggagacaucacccauauuacaggcucucacaacuacaccaugaaucucgcuucccagaacuggaauaacuaugaucccaccgaggaaaucccugcgccccugggcacaccggacuucguggggaagauccagggaguucuuacgcagaccacacggaccgacggcagcacacgcgggcauaaagccaccguguacacgggauccgcugaguuugccccuaagcugggcagaguccaauucgaaacagauaccaaucacgacuuugaggccaaccagaauaccaaguucacacccguggggguuauucaggauggaucuaccacacaccggaacgaaccccaacagugggugcucccuagcuacuccggccgcaauacgcauaacguccaccuggcuccggccguggcgcccaccuuuccuggcgagcagcuucuguucuuuagaagcacaaugcccggguguucuggauauccuaauauggaccucgauugccugcugccccaggagugggugcaauacuucuaucaggaagcugccccugcccaguccgacguugcucuccugcgguuugucaaccccgauaccggcagagugcuuuucgaguguaaacugcauaagagcggguacgugacagucgcccacaccggacagcacgaccucgugaucccgccuaacggcuauuuucgcuucgauucuuggguuaaucaauucuacacgcuggcucccauggggaacggcaccggacggagacgcuga

SEQ ID NO: 29604 - RNA, 1617 nt, Artificial Sequence
  derived and/or modified sequence opt5 from VP1__Norovirus_and/or_Norovirus-like__KX354110
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagcggcuguucacagggccuucuuccgccuucgugguccagccccagaacggacgcuguaccacagauggcgugcuccuggggaccacgcaacugagcccugucaauauuugcacauuuagaggagacgugacccauaucacaggcucucacaacuacaccaugaaucucgcuucccagaacuggaauaacuaugaucccaccgaggaaauuccugcgccccugggcacaccggacuucguugggaagauccagggagugcuuacgcagaccacaagcaccgacggcuccacacgggggcauaaagccaccgucuacacgggaucugcugaguuugccccuaagcugggccgcgugcaauucgaaacagauaccgaccacgauuuugagaccaaucagaacacaaaguucacccccguuggggugauccaggacggaagcacaacgcacagaaaugaaccccaacaguggguccucccuuccuacagcggccggaacacccauaaugugcaccuggccccggcuguggcccccacauuuccuggcgagcagcuucuguucuuucgcucuaccaugcccggguguuccggauauccuaacauggaucucgacugccugcugccccaggaguggguucaauacuucuaucaggaagcggcuccugcccagagcgaugucgcccuccugagauuugugaaucccgacacaggccgggugcuuuucgaguguaaacugcauaagucuggguacauuaccgucgcucacacgggacagcacgaucucgugaucccgccuaacggcuauuuuagauucgacagcuggguuaaccaauucuacacccuggcccccauggggaauggcacaggacgccggagauga

SEQ ID NO: 29605 - RNA, 1617 nt, Artificial Sequence
  derived and/or modified sequence opt5 from VP1__Norovirus_and/or_Norovirus-like__KX354107
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacauuaucgacccuuggauuagaaauaacuucgugcaggcccccggcggggaauuuaccguuuccccucggaaugcgcccggagagauccuguggucugccccucuuggcccggaucugaaccccuaccucagccaccuggcucgcauguauaauggguacgccggaggcuucgaagugcaggucauucuugcuggcaacgccuuuacagcggggaaagugaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaugaccccacaaucaagcucauugccaugcuguauacaccccuucgcgcuaacaacgccggcgaugacguguucaccguguccugcagaguccugacccggccuagcccggauuuugacuucaucuuucucgugcccccuacaguugaaucucgcaccaaacccuucuccgugccuguccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggaauaacuaugaucccaccgaggaaaucccugcgccccugggcacaccggacuucguggggaaaauccagggaguucuuacgcagaccacacggaccgacggcagcacacgcgggcacaaggccaccguguacacgggauccgcugauuuugccccuaagcugggcagaguccaauucgagacagacaccgaucaugacuuugaagccaaucagaacaccaaauucacacccguggggguuauucaggauggaucuaccacacaccggaaugagccccaacagugggugcucccuagcuacuccggccgcaacacgcacaauguccaucuggcuccggccguggcgcccaccuuuccuggcgaacagcuucuguucuuuagaagcacaaugcccggguguucuggauauccuaacauggaccucgauugccugcugccccaggagugggugcaauacuucuaucaggaggcugccccugcccaguccgacguugcucuccugcgguuugucaaucccgauaccggcagagugcuuuucgaauguaagcugcacaaaagcggguacgugacagucgcccauaccggacagcacgaccucgugaucccgccuaacggcuauuuucgcuucgauucuuggguuaaccaauucuacacgcuggcucccauggggaauggcaccggacggagacgcuga

SEQ ID NO: 29606 - RNA, 1617 nt, Artificial Sequence
  derived and/or modified sequence opt5 from VP1__Norovirus_and/or_Norovirus-like__KX353991
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaacuccagaauccccauuccgcuugagaagcuguuuaccgggccuagcucugccuucgugguucagccccagaauggacgguguacaaccgauggcgugcuccuggggacgacacaacuguccccugucaacaucugcaccuuccgcggagacgugacacauaucgccggcagcagaaauuacaccaugaaccucgcuucucagaauuggaacuccuaugaucccaccgaggaaauuccugcgccccugggcacaccggacuuugucgggaaaauccagggagugcuuacgcagaccacacggaccgacggcagcacacgcgggcacaaggccaccguuuacacgggauccgcugauuucucuccuaagcugggcagagugcaauuugccacagacaccgauaaugacuucgagaccaaccagaauacaaaauuuacccccgucggggugauucaggauggaggcacaacgcaucggaacgaaccccaacaguggguucucccuagcuacuccggccgcaauacccacaacgugcaccuggccccggcugucgcccccacauucccuggggagcagcuucuguuuuucagaagcaccaugcccggauguucuggcuauccuaauauggaccucgauugccugcugccccaggaaugggugcaauacuuuuaucaggaggcggcuccugcccaguccgacguggcccuccugcgguucguuaaccccgauacagggagaguccuuuuugaguguaagcugcauaaaagcggauacgugaccguggcucacacgggccagcaugaccucgucaucccgccuaacggguauuuccgcuuugauucuugggugaaucaauucuacacccuggcccccaugggcaacggaacaggccggagacgcuga

SEQ ID NO: 29607 - RNA, 1617 nt, Artificial Sequence
  derived and/or modified sequence opt5 from VP1__Norovirus_and/or_Norovirus-like__KU985162
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuugccccuaagcugggccgcgugcaauucgagacagacaccaaucacgauuuugaagccaaccagaauaccaaauucacacccguuggggugauccaggacggaucuaccacacacagaaacgagccccaacaguggguccucccuagcuacuccggccggaauacgccgaacgugcaucuggcucccgccguggcgccuaccuuucccggcgaacagcuucuguucuuucgcagcacaaugccuggguguucuggauaucccaauauggaucucgacugccugcugccucaggaguggguucaauacuucuaucaggaggcugcccccgcccaguccgaugucgcucuccugagauuugugaacccggacaccggccgggugcuuuucgaauguaagcugcacaaaagcggguacgucacaguggcccauaccggacagcacgaucucguuauuccucccaacggcuauuuuagauucgacucuugggugaaucaauucuacacgcuggcuccuauggggaacggcaccggacgccggagauga

SEQ ID NO: 29608 - RNA, 1617 nt, Artificial Sequence
  derived and/or modified sequence opt5 from VP1__Norovirus_and/or_Norovirus-like__AB972476
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucgaaacagacaccgagaacgauuuugaaacccaucaaaauacaaaguucacccccguuggagugauucaggacggcggcacaacgcaccgcaacgagccccagcaauggguccugccuucuuacagcgggagaaaugugccgaacguucaccuugcccccgcuguggccccuaccuuucccggagagcagcuccuguucuuucgguccacaaugccuggcuguagcggguaucccaauauggaucuggacugccugcucccucaggaauggguccagcauuucuaccaagaggcggcucccgcccagucugauguggcccugcuucgcuuugugaacccggacaccggaagaguucuguucgaauguaaacuccacaaguccggcuaugucacaguggcucauaccgggcagcacgaucuggugaucccucccaacggcuacuuucgguucgacagcugggucaaucaguucuauacgcuugccccuaugggaaacggcaccgggagacgccgguga

SEQ ID NO: 29609 - RNA, 1617 nt, Artificial Sequence
  derived and/or modified sequence opt5 from VP1__Norovirus_and/or_Norovirus-like__KU311162
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaggacuccacaauuaaacucaucgccaugcuguauacaccccuucgcgcuaauaacgccggcgaugacguuuucaccgugagcugcagagugcugacccggcccucuccugauuuugacuucauuuuucucgucccgcccacaguggaaucccgcaccaagccuuucacgguucccauccugaccguggaggaaaugacaaacagcagauuuccuauuccccuugagaaacuguucaccgggccgucuaaugccuucgucgugcagccucagaacggacgguguacaaccgauggcguucuccuggggacgacacaacugucccccgugaauaucugcaccuuucgcggagacgucacacagaucgcuagcacccagaccuacacaaugaaccucgcgucucugaauuggaacaauuaugauccuacggaggaaauucccgccccucuuggcgcucccgacuucaugggcaagauccagggggugcugacccaaacaaccagacagggaggcuccacacgggggcauaaggccaccgucagcacgggauccgugcacuuuacaccgaaacucggcucuguucgcuucgacaccgauaccaacaaugaccugcagccucaucaaagcacaagauuuacccccgugggggucauucaggauggagacacacaccagaacgagccccagcaaugggcccuuccuuguuacuccggccgggaugugaauaacguucaccuggcuccggccguggcgcccagcuucccuggcgaacagcuccuguuuuuccgcucuacgaugcccgggugcuccggauacccuaauauggaccuggauugucuccugccccaggaguggguccagcauuuuuaucaagaagcugccccugcccagagcgacguggcccuucugagauucgugaaccccgauaccggccggguucucuuugagugcaagcugcacaaaucuggguacgucacaguggcucauaccggacagcacaaucuugugaucccgccuaacggcuauuucagauuugacagcugggucaaccaguucuacacacuggcucccauggggaauggcaccggacgccggagaguguga

SEQ ID NO: 29610 - RNA, 1617 nt, Artificial Sequence
  derived and/or modified sequence opt5 from VP1__Norovirus_and/or_Norovirus-like__KR904212
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaccuucgcggccguuccucccaauuuuccuacagagggacugucccccucucaggugaccauguucccgcauaucaucgucgacgugagacaacucgagccugugcugauuccccugccugauguccggaacaauuuuuaucacuacaaccagagcaaugaccccacaaucaagcucauugcuaugcuguauacaccccuucgcgccaacaacgcuggcgaugacguuuucaccguguccugcagagugcugacccggccuagcccggauuuugacuucaucuuucucgugcccccuacggucgaaucucgcaccaaacccuucuccguuccuauucugacaguggaggaaaugaccaauagcagauuucccaucccgcuugagaagcuguucacagggccuucuuccaccuucgucgugcagccccagaacggacgguguacgacagauggcguucuccuggggaccacacaacugagcccugugaauauuugcaccuuucgcggagacgucacccauaucacaggcucucacaacuacacgaugaaucucgccucccagaacuggagcuccuaugaucccaccgaggaaaucccugcuccccugggcacaccggacuucguggggaaaauucagggaguccuuacccagacaaccagaacggacggcucuacacgggggcauaaggccaccguguuuaccggaagcgcggauuucuccccuaagcugggccgcguucaauuugccacagacaccgauaaugacuucguggcuaaccagaauacaaaauuuacgcccgucggggugauccaggauggaggcaccgcccacagaaacgagccccaacaguggguucucccuagcuacucuggccggaauauucacaacgugcaucuggccccggcugucgcccccacauucccuggggaacagcuucuguuuuuccgcuccaccaugcccggauguagcggcuacccuaauauggaccucgauugccugcugccccaggagugggugcaauauuuuuaccaggaagcggcuccugcccagucugacguggcccuccugagauucguuaaccccgauacagggcggguccuuuuugaguguaagcugcacaaaagcggauaugugaccguggcucauacgggccagcacgaccucgucaucccgccuaauggguacuucagauucgauuccugggugaaccaauuuuauacccuggcccccaugggcaacggaacaggccgccggagauga

SEQ ID NO: 29611 - RNA, 1617 nt, Artificial Sequence
  derived and/or modified sequence opt5 from VP1__Norovirus_and/or_Norovirus-like__AB933678
augaagauggccagcaacgacgcuaaucccuucgauggcuccgccgcgaaccuggugccugaggucaauaacgaaguuauggcucucgagccgguggugggggccgccaucgcugcccccgucgcuggacagcaaaaugugauugacccuuggaucagaaacaauuuuguucaggcccccggcggggaguucaccgugucuccucggaacgcgcccggagaaauucuguggagcgccccucuuggcccggaucugaaucccuaccucucccaccuggcucgcauguauaacggguacgccggaggcuuugaaguccaggugauccuugcuggcaaugccuucacagcggggaaaauuaucuuugccgcuguuccucccaacuucccugccgagggacugucucccagccaggugacgauguuuccgcauaucauugucgacgugagacaacucgagccugugcugaucccccugccugauguccggaauaacuucuaucacuacaaucaguccaacgacucuaccauuaagcucaucgcuaugcuguauacaccccuucgcgccaacaaugccggcgaagauguuuuuaccgugagcugcagagugcugacacggcccuccccugacuucgauuuuauuuuccucgucccgcccaccguggagagccgcacaaaaccuuuuaccguucccauccugacgguggaagagaugaccaacucuagauucccuauuccccuugagaagcuguucacagggccguccagcgcuuuugucgugcagccucagaauggacgguguaccacagacggcguucuccuggggaccacgcaacugucucccgugaacaucugcacauuccgcggagaugucacccauaucgcgggcuccagaaauuacacaaugaaccucgccagccugaauuggaacaauuaugacccuaccgaagagauucccgcuccucuuggcacccccgauuuuguggggaaaauccagggaguccugacacagacgaccaagggcgacgggucuacacggggacacaaggccaccguguacacaggcuccgccccguucaccccuaaacucgggagcguucaguuuuccacggacacagaaaacgauuucgagacccaucaaaauaccaaguuuacacccgugggagucauucaggacggcggcaccacacaccgcaacgaaccccagcaaugggugcugccuucuuacagcgggagaaauguuccgaacgugcaccuugcucccgccgucgcgccuacguuccccggagagcagcugcucuuuuuccgguccaccaugccuggcuguagcggguaucccaauauggaucuggacugccugcucccucaggagugggugcagcauuuuuaccaagaagcugcccccgcccagucugauguggcucugcuucgcuucguuaacccggacacaggaagaguccuguuugaguguaaacuccacaaguccggcuaugugaccguggcccauacagggcagcacgaucuggucaucccucccaacggcuacuuccgguucgacagcugggugaaucaguuuuauacccuugcuccuaugggaaacggcacggggagacgccgguga

SEQ ID NO: 29612 - RNA, 1617 nt, Artificial Sequence
  derived and/or modified sequence opt5 from VP1__Norovirus_and/or_Norovirus-like__AB933648
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugagacccaucaaaacacaaaguucacccccgugggcgucauucaggacggcagcacaacgcaccgcaaugaaccccagcaaugggugcugccuuccuacagcgggagagauguucacaacgugcaucuugccccggcugucgcccccaccuuuccuggagagcagcuccuguucuuucggucuacaaugcccggcuguuccggguauccuaauauggaccuggauugccugcucccccaggagugggugcagcacuucuaccaagaagcggcuccugcccagagcgacguggcccugcuucgcuuuguuaaccccgauaccggaagaguccuguucgaguguaaacuccauaagucuggcuaugugacaguggcucacaccgggcagcacgaccuggucaucccgccuaauggcuacuuucgguucgauagcugggugaaccaguucuauacgcuugcccccaugggaaacggcaccgggagacgccgguga

SEQ ID NO: 29613 - RNA, 1617 nt, Artificial Sequence
  derived and/or modified sequence opt5 from VP1__Norovirus_and/or_Norovirus-like__LN854571
augaagauggccagcaacgacgcugcccccuccgauggcucuaccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugaccccaccauuaagcucaucgccaugcuguauacaccccuucgcgcuaacaacgccggcgaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaauuccagauuucccaucccgcuugagaagcuguucaccgggccuagcucugccuucgugguucagccccagaacggacgguguacaaccgauggcgugcuccuggggacgacacaacuguccccugucaauauuugcaccuuucgcggagacgugauccauauccccggcagcagaaacuacacaaugaaucucgcuucucagaacuggaacuccuaugauccuaccgaggaaauucccgcgccgcugggcaccccugacuucgucgggaaaauccagggagugcuuacacagacgacccggacaaauggcagcacccgcgggcacaaggccacaguuuacaccggauccgcugacuuuucucccaagcugggcagagugcaauucgccacggauacagacaaugauuuugagaccaaccagaauaccaaauucacacccgucggggugauucaggacggaagcaccacaccucggaacgaaccgcaacaguggguucuccccuccuacagcggccgcaauauccauaacgugcaccuggccccugcugucgcccccacguuuccuggcgagcagcuucuguucuuuagaucuaccaugcccggguguuccggauauccuaauauggaucucgacugccugcugccccaggaaugggugcaauacuucuaucaggaggcggcuccggcccagagcgauguggcccuccugcgguuuguuaacccugacacaggcagaguccuuuucgaguguaagcugcacaaaucuggguacgugaccguggcucauacaggacagcacgaucucgucauucccccuaacggcuauuuucgcuucgacagcugggugaaucaauucuacacccuggcccccauggggaacggcacgggacggagacgcuga

SEQ ID NO: 29614 - RNA, 1617 nt, Artificial Sequence
  derived and/or modified sequence opt5 from VP1__Norovirus_and/or_Norovirus-like__EU921384
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugagacccaucaaaacacaaaguucacccccgugggcgucauucaggacggcagcacaacgcaccgcaaugaaccccagcaaugggugcugccuuccuacagcgggagaaacguucacaaugugcaucuugccccggcugucgcccccaccuuuccuggagagcagcuccuguucuuucggucuacaaugcccggcuguuccggguauccuaacauggaucuggacugccugcucccccaggagugggugcagcacuucuaccaagaagcggcuccugcccagagcgauguggcccugcuucgcuuuguuaaucccgacaccggaagaguccuguucgaguguaaacuccauaagucuggcuaugugacaguggcucacaccgggcagcacgaucuggucaucccgccuaacggcuacuuucgguucgacagcugggugaaccaguucuauacgcuugcccccaugggaaauggcaccgggagacgccgguga

SEQ ID NO: 29615 - RNA, 1617 nt, Artificial Sequence
  derived and/or modified sequence opt5 from VP1__Norovirus_and/or_Norovirus-like__LC005716
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuggcaacuacaccaugaaucucgcguccgugaacuggaauaacuaugacccuaccgaagagauucccgccccucuggggacacccgauuucgucggaaaaauccagggcaugcuuacgcagaccacaaagggggacggaagcaccagaggccacaaggcuacaguguacaccggguccgccccguuuacgccuaaacugggaucuguucaguucagcacagacaccgaaaaugauuuugagacccaucaaaacacaaaguucacccccgugggcgucauucaggacggcaauacaacgcaccggaacgaaccccagcaaugggugcucccuuccuacagcgggcgcaauguuccgaacgugcaccuggcccccgcugucgccccuaccuuucccggagagcagcuucuguucuuuagaucuacaaugccuggcuguuccggguaucccaauauggaucucgacugccugcugccucaggagugggugcagcauuucuaccaagaagcggcucccgcccagagcgauguggcccuccugcgguuuguuaacccggacaccggacgcguccuuuucgaguguaaacugcacaagucuggcuaugugacaguggcucauaccgggcagcacgaucucgucaucccucccaacggcuacuuuagauucgacagcugggugaaucaguucuauacgcuggccccuaugggaaacggcaccgggcggagacgcuga

SEQ ID NO: 29616 - RNA, 1617 nt, Artificial Sequence
  derived and/or modified sequence opt5 from VP1__Norovirus_and/or_Norovirus-like__KP241914
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauuggaacaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuuagcccuaagcugggcagagugcaauucgagacagacaccgaucgggacuuugaagccaaccagaauaccaaauucacacccguuggggugauccaggauggaggcaccacacaucgcaacgagccccaacaguggguccucccuuccuacagcggcagaaaugccccgaacgugcaccuggcucccgccguggcgccuacguuucccggggaacagcuucuguucuuucggucuaccaugccuggauguuccggcuaucccaauauggaccucgauugccugcugccucaggaguggguucaauacuucuaucaggaggcugcccccgcccagagcgacgucgcucuccugagauuugugaacccggauacagggcgcgugcuuuucgaauguaagcugcacaaaucuggauacgucaccguggcccauacaggccagcacgaccucguuauuccucccaauggguauuuucgguucgauagcugggugaaccaauucuacacccuggcuccuaugggcaacggaacgggcagacgccgguga

SEQ ID NO: 29617 - RNA, 1617 nt, Artificial Sequence
  derived and/or modified sequence opt5 from VP1__Norovirus_and/or_Norovirus-like__KJ433968
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcucccugggaccacgcaacugagccccgucaauauuugcacauuucgcggagacgugacccauaucacaggcucuagaaacuacaccaugaaucuggcuucccagaacuggaauaacuaugauccuaccgaggaaauucccgcgccgcucggcacaccugacuucguugggaaaauccagggagugcugacgcagaccacacggagcgacggcuccacccgcgggcacaaggccacagucuacaccggaucugcugauuuugcccccaaacuuggcagagugcaauucgagacggacacagaucgggacuuugaagccaaucagaacaccaaguucacccccguuggggugauccaggauggaggcacaacccaucgcaaugagccucaacaguggguccugccgagcuacuccggcagaaacacacccaaugugcaccucgcuccugccguggcgcccacguuuccuggggaacagcugcuuuucuuucggagcaccaugcccggauguucuggcuauccuaacauggaccuggauugccuccugccccaggaguggguucaauacuucuaucaggaggcugccccggcccaguccgacgucgcucugcucagauuugugaauccugauacagggcgcgugcuguucgaauguaaacuucacaagagcggauacgucaccguggcccauacaggccagcacgaccugguuauucccccuaacggguauuuucgguucgauucuugggugaaccaauucuacacccucgcucccaugggcaauggaacgggcagacgccgguga

SEQ ID NO: 29618 - RNA, 1617 nt, Artificial Sequence
  derived and/or modified sequence opt5 from VP1__Norovirus_and/or_Norovirus-like__KP176409
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucgggacuuugaagccaaucagaacaccaaauucacacccguuggggugauccaggauggaggcaccacacaucgcaaugagccccaacaguggguccucccuuccuacagcggcagaaacacgccgaaugugcaccuggcucccgccguggcgccuaccuuucccggggaacagcuucuguucuuucggucuacaaugccuggauguuccggcuaucccaacauggaccucgauugccugcugccucaggaguggguucaauacuucuaucaggaggcugcccccgcccagagcgacgucgcucuccugagauuugugaauccggauaccgggcgcgugcuuuucgaauguaagcugcacaaaucuggauacgucacaguggcccauaccggccagcacgaccucguuauuccucccaacggguauuuucgguucgauagcugggugaaucaauucuacacgcuggcuccuaugggcaacggaaccggcagacgccgguga

SEQ ID NO: 29619 - RNA, 1617 nt, Artificial Sequence
  derived and/or modified sequence opt5 from VP1__Norovirus_and/or_Norovirus-like__KM514064
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcuccgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcucccacaauuacaccaugaaccucgcuagccagaauugguccaacuaugaucccaccgaggaaauuccugcgccccugggcacaccggacuucguugggaaaauccagggagugcuuacgcagaccacaagaaccgacggcucuacacgggggcauaaggccaccgucuacacgggaagcgcugauuuugccccuaagcugggccgcgugcaauucgagacagacaccaaucacgauuuugaagccaaccagaauaccaaauucacacccguuggggugauccaggacggauccaccacacacagaaacgagccccaacaguggguccucccuagcuacucuggccggaauacgccgaacgugcaucuggcucccgccguggcgccuaccuuucccggcgaacagcuucuguucuuucgcuccacaaugccuggguguagcggauaucccaauauggaucucgacugccugcugccucaggaguggguucaauacuucuaucaggaggcugcccccgcccagucugaugucgcucuccugagauuugugaacccggacaccggccgggugcuuuucgaauguaagcugcacaaaagcggguacgucacaguggcccauaccggacagcacgaucucguuauuccucccaauggcuauuuuagauucgacuccugggugaaccaauucuacacgcuggcuccuauggggaacggcaccggacgccggagauga

SEQ ID NO: 29620 - RNA, 1617 nt, Artificial Sequence
  derived and/or modified sequence opt5 from VP1__Norovirus_and/or_Norovirus-like__KJ649703
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuuucuccuaagcugggccgcauccaauucgagacagacaccaaucacgauuuugaagccaaccagaauaccaaauucacacccguggggguuauucaggacggaggcaccacacacagaaacgagccccaacagugggugcucccuagcuacuccggccggaauacgccgaacguccaucuggcccccgcuguggccccuaccuuucccggggaacagcuucuguucuuucgcagcacaaugccuggauguucuggcuaucccaauauggaucucgacugccugcugccucaggagugggugcaauacuucuaucaggaggcggcucccgcccaguccgauguugcccuccugagauuugucaacccggacaccgggcgggugcuuuucgaauguaagcugcacaaaagcggauacgugacagucgcucauaccggccagcacgaucucgugaucccucccaacggguauuuuagauucgacucuuggguuaaucaauucuacacgcuggccccuaugggcaacggaaccggccgccggagauga

SEQ ID NO: 29621 - RNA, 1617 nt, Artificial Sequence
  derived and/or modified sequence opt5 from VP1__Norovirus_and/or_Norovirus-like__KF177447
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacauuaugaaucucgcuucccagaacuggagcaauuaugaucccaccgaggaaaucccugcgccccugggcaccccggacuucguugggaaaauccagggagugcuuacacagacgacccggacagacggcuccacccgcgggcacaaggccacagucuacaccggaucugcugauuuugccccuaagcugggcagagugcaauucgagacggacacagaucaugacuuugaagccaaccagaauaccaaauucacccccguuggggugauucaggauggaagcacaacccaccggaacgagccccaacaguggguccucccuuccuacagcggccgcaauacaccgaacgugcaccuggcucccgccguggcgccuacguuucccggcgaacagcuucuguucuuuagaucuaccaugccuggguguuccggauaucccaauauggaccucgauugccugcugccucaggaguggguucaauacuucuaucaggaggcugcccccgcccagagcgacgucgcucuccugcgguuugugaacccggauacaggcagagugcuuuucgaauguaagcugcauaaaucuggguacgucaccguggcccacacaggacagcaugaccucguuaucccucccaauggcuauuuucgcuucgauagcugggugaaccaauucuacacccuggcuccuauggggaacggcacgggacggagacgcuga

SEQ ID NO: 29622 - RNA, 1617 nt, Artificial Sequence
  derived and/or modified sequence opt5 from VP1__Norovirus_and/or_Norovirus-like__JX439820
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaacuccagauuucccaucccgcuugagaagcuguucaccgggccuagcucugccuucgugguucagccccagaauggacgguguacaaccgauggcgugcuccuggggacgacacaacuguccccugucaacauuugcaccuuucgcggagacgugacacauaucucuagcuccagaaauuacaccaugaaccucgccagccagaauugguccucuuaugaucccaccgaggaaaucccugcuccccugggcacaccggacuucgucggcaaaauucagggggugcuuacgcagaccacacggaccgacggaagcacacgcggccacaaggcgaccguuuacacgggguccgccgauuuuagcccuaagcugggaagagugcaauucgacacagauaccgacaacgauuuugagaccaaucagaacacaaaauucacccccgucggcgugauccaggacgggucuacaacguaccggaaugaaccccaacaguggguucucccuuccuauagcggacgcaacacccauaaugugcaccuggcuccggccgucgcccccacauuuccuggcgagcagcuucuguucuuuagaucuaccaugcccggcuguagcggguacccuaacauggaucucgacugccugcugccccaggaaugggugcaauauuucuaccaggaggcugccccugcgcaguccgauguggcucuccugcgguuuguuaaucccgacacaggaagaguccuuuucgaguguaagcugcacaaaucuggcuaugugaccguggcccauacggggcagcacgaucucgucauuccgccuaacggauacuuucgcuucgacagcugggugaaccaauucuauacccuggcccccaugggcaaugggacaggccggagacgcuga

SEQ ID NO: 29623 - RNA, 1617 nt, Artificial Sequence
  derived and/or modified sequence opt5 from VP1__Norovirus_and/or_Norovirus-like__HF952120
augaagauggccagcuccgacgcuaaccccucugauggcagcaccgccaaucuggugccugaggucaacaaugaaguuauggcgcucgagccgguggugggggcugccaucgccgcucccgucgccggacagcaaaacauuaucgacccuuggauuagaaauaacuucgugcaggcucccggcggggaauuuacaguuuccccucggaaugcccccggagagauccuguggucugcgccucuuggcccggaucugaaccccuaccucagccaccuggcccgcauguauaauggguacgcuggaggcuucgaagugcaggucauucuugccggcaacgcuuuuacggccgggaaaaucaucuucgcggccgugccucccaauuuuccuaccgagggacugucccccucucagguuacaauguucccgcauauuaucguggacgucagacaacucgagccugugcuggugccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucuagaaacuacaccaugaaucucgcuucccagaacuggaauagcuaugaucccaccgaggaaauuccugcgccccugggcacaccggacuucguggggaaaauccagggaguccuuacgcagaccacacggaccgacggcuccacacgcgggcacaaggccaccguguacacgggaucugcugauuuuagcccuaagcugggcagaguucaauucgccacagacaccgauaacgacuuugaggccaaucagaacaccaaauucacacccgugggggucauucaggauggauccaccgcucaucggaaugaaccccaacagugggugcucccuagcuacucuggccgcaacauccacaauguucaccuggccccggcgguggcucccacauuuccuggcgagcagcuucuguucuuuagauccacgaugcccggguguagcggauauccuaacauggaccucgauugccugcugccccaggaauggguccaauacuucuaucaggaggccgccccugcucagucugacguggcccuccugcgguuugugaaucccgauaccggcagaguucuuuucgaguguaagcugcauaaaccgggguacgucacaguggcucacaccggacagcaugaccucgugauuccucccaacggcuauuuucgcuucgauagcugggucaaccaauucuacacacuggccccuauggggaauggcaccggacggagacgcuga

SEQ ID NO: 29624 - RNA, 1617 nt, Artificial Sequence
  derived and/or modified sequence opt5 from VP1__Norovirus_and/or_Norovirus-like__KC517369
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccacgguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcucugccuucgucgugcagccucagaauggacgguguaccacggacggcguucuccuggggacaacccaacugucccccgugaacaucugcacauuucgcggagaugucacccauaucgccggcagcagaaauuacaccaugaaccucgcuucucugaauuggaacaauuaugacccuacagaagagauucccgcgccucuuggcacgcccgauuucguggggaaaauccagggaguccugacccagacaaccaagggcgacggguccacacggggacacaaggccaccguguacacgggcagcgcuccguuuacaccuaaacucggguccguucaguucgaaaccgacaccgagaacgauuuugaaacacaucaaaauaccaaguucacacccgugggagucauucaggacggcggcacgacccaccgcaacgagccccagcaaugggugcugccuucuuacagcgggagaaauguuccgaacgugcaccuugcccccgccgucgcuccuacauuucccggagagcagcuccuguucuuucgguccaccaugccuggcuguagcggguaucccaauauggaucuggacugccugcucccucaggaaugggugcagcauuucuaccaagaggccgcgcccgcucagucugauguggcccugcuucgcuuuguuaacccggacacaggaagaguccuguucgaauguaaacuccacaaguccggcuaugugaccguggcccauacggggcagcacgaucuggucaucccucccaacggcuacuuucgguucgacagcugggugaaucaguucuauacccuugcuccuaugggaaacggcacagggagacgccgguga

SEQ ID NO: 29625 - RNA, 1617 nt, Artificial Sequence
  derived and/or modified sequence opt5 from VP1__Norovirus_and/or_Norovirus-like__KC409293
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagagauguucagaacgugcaccuugccccggcugucgcccccacauuuccuggcgagcagcuccuguucuuucgguccaccaugcccggguguagcggauauccuaauauggaccuggauugccugcucccccaggagugggugcaacauuucuaccaggaagcggcuccugcccagucugacguggcccugcuucgcuuuguuaaccccgauacaggcagaguccuguucgaguguaaacuccacaaguccggguaugugaccguggcucauacgggccagcacgaccuggucaucccgccuaauggauacuuucgguucgauagcugggugaaccaauucuauacccuugcccccaugggcaacgggacaggaagacgccgguga

SEQ ID NO: 29626 - RNA, 1617 nt, Artificial Sequence
  derived and/or modified sequence opt5 from VP1__Norovirus_and/or_Norovirus-like__JX984951
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucgcuucucuacagacaccgaaaacgauuuugagacccaucagaauacaaaguucacccccgugggagucauucaagacggcggcacaacgcacagaaacgaaccccagcagugggugcugccuaauuacagcggguccgauguuccgaacgugcaccuugcccccgcugucgccccuaauuuucccggagagcaacuccuguucuuucggagcaccaugccuggcuguucuggguaucccaacauggaccuggauugccugcucccucaggagugggugcagcauuucuaccaggaagcggcucccgcccaauccgacguggcccugcuucgcuuuguuaacccggauacaggaagaguccuguucgaguguaaacuccacaagagcggcuaugugaccguggcucauacagggcagcacgaccuggucaucccucccaauggcuacuuucgguucgauucuugggugaaccaguucuauacccuugccccuaugggaaauggcacggggagacgccgguga

SEQ ID NO: 29627 - RNA, 1617 nt, Artificial Sequence
  derived and/or modified sequence opt5 from VP1__Norovirus_and/or_Norovirus-like__JX459612
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacuccuacgcugggggauucgaaguccaggugauccuugccggcaaugcuuuuacggccggcaaaauuaucuucgcggccguuccucccaacuuuccuaccgaggggcugucucccagccaggugacaauguucccgcacaucauugucgacgugagacaacucgagccugugcugaucccccugccugauguccggaauaacuuuuaucauuacaaucaguccaacgaccccaccauuaagcucaucgcuaugcuguauacaccccuucgcgccaauaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaacucuagauuucccauuccgcuugagaagcuguucaccggcccuuccagcgccuucgucgugcagccccagaaugggcgguguacaaccgauggaguucuccugggcacgacacaacugucuccugugaacaucugcaccuuucgcggggacgucacacacaucgccggaacccaggaguacaccaugaaucucgcuucccagaacuggaauaacuaugaucccacagaagagauuccugcgccccugggcacgccggacuucgugggcaaaauccaggggguccuuacccaaacaaccagcagagacggauccacacggggccauaaggccaccgugucuacggggagcguucacuuuacaccuaagcugggacgcgugcaguucuccaccgauaccagcaaugacuuugaaacaggccagaacaccagauucacacccgucggggugguucaagauggaucuacgacccaccagaaugagccccagcagugggugcucccuaacuacuccggccgggacagccauaauguccaccuggcuccggccguggcccccucuuuuccuggcgaacaacuucuguucuuucgcagcacaaugcccggguguuccggauacccuaacaugaaucucgauugccugcugccccaggagugggugcagcauuucuaucaggaggcugccccugcgcaaucugacguugcucuccugagauuugucaaccccgauaccggccgggugcuuuucgaauguaaacugcacaagagcggguacgugacagucgcccacaccggacagcaugaccucgugauuccgccuaauggcuauuuuagauucgauuccuggguuaaccaguucuacacgcuggcccccauggggaacggcaccggacgccggagauga

SEQ ID NO: 29628 - RNA, 1617 nt, Artificial Sequence
  derived and/or modified sequence opt5 from VP1__Norovirus_and/or_Norovirus-like__JX459604
augaagauggccagcaacgacgugacccccuccgauggcucugcugccaaucuggucccugagguuaacaaugaagugauggcgcucgagccgguggucggggcugccaucgccgcucccguggccggacagcaaaacguuauugacccuuggaucagaaauaacuucgugcaggcucccggcggggaauuuacagucagcccucggaaugcccccggagagauucugugguccgcgccucuuggcccggaucugaaccccuaccucucucaccuggcccgcauguauaauggguacgcuggaggcuucgaagugcagguuauccuugccggcaacgcuuuuacggccgggaaaauuaucuucgcggccgugccucccaauuuuccuaccgagggacugagccccucccaggucacaauguucccgcauaucauuguggacgugagacaacucgagccuguccugaucccccugccugauguucggaacaauuuuuaucacuacaaccagucuaaugacagcaccauuaagcucaucgcuaugcuguauacaccccuucgcgccaacaacgcuggcgaagauguguucaccguguccugcagaguccugacacggcccagcccugacuuugauuucauuuuucucgugccgcccaccguugagucucgcacgaaaccuuucaccgugcccauccugacagucgaagagaugaccaauuccagauuuccuauuccccuugagaagcuguucacagggccgagcggagccuucgugguucagccucagaacggccgguguaccacggacggggugcuccugggaacaacccaacugucucccgucaauaucugcacauuucgcggcgaugugacccauaucgccggcuccagaaacuacaccaugaaucucgcuagccugaacuggaauaacuaugacccuacagaagagauucccgcgccucuugggacgcccgauuucgucggaaaaauccagggcgugcugacccagacaaccaagggggacggaucuacacggggccacaaggccaccguuuacacgggguccgcuccguuuacaccuaaacucggaagcgugcaguucuccaccgacaccgaaaaugauuuugagacacaucaaaacaccaaguucacacccgucggcgugauucaggacggcgggacgacccaccgcaaugaaccccagcaauggguucugccuucuuacagcggaagaaacgugcacaauguccaucuugccccggccguggcucccacauuuccuggcgagcagcuccuguucuuucgguccaccaugcccggguguagcggauauccuaacauggaucuggacugccugcucccccaggagugggugcagcacuucuaccaagaagccgcgccugcucagucugauguugcccugcuucgcuuugucaaucccgacacaggcagagugcuguucgaguguaaacuccauaaguccggguaugugaccgucgcccacacgggccagcacgaucuggugaucccgccuaacggauacuuucgguucgacagcuggguuaaccaguucuauacccuugcucccaugggcaaugggacaggaagacgccgguga

SEQ ID NO: 29629 - RNA, 1617 nt, Artificial Sequence
  derived and/or modified sequence opt5 from VP1__Norovirus_and/or_Norovirus-like__JX155745
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacacggggcgacggguccacccgcggacacaaggcuacaguguacaccggcagcgccccguuuacgccuaagaugggguccguucaguucucuacagacaccgaaaacgauuuugagacccaucaaaauacaaaauucacccccgugggagucauucaggacggcggcacaacgcacagaaacgaaccccagcaaugggugcucccuagcuacuccgggcggaauguuccgaacgugcaccuggcccccgcugucgccccuaccuuucccggagagcagcuucuguucuuucgcagcacaaugccuggcuguucuggguaucccaauauggaucucgacugccugcugccucaggagugggugcagcauuucuaccaagaagcggcucccgcccaguccgauguggcccuccugagauuuguuaacccggacaccggacggguccuuuucgaguguaagcugcacaaaagcggcuaugugacaguggcucauaccgggcagcacgaucucgucaucccucccaacggcuacuuuagauucgacucuugggugaaucaguucuauacgcuggccccuaugggaaacggcaccgggcgccggagauga

SEQ ID NO: 29630 - RNA, 1617 nt, Artificial Sequence
  derived and/or modified sequence opt5 from VP1__Norovirus_and/or_Norovirus-like__HM635155
augaagauggccagcuccgacaccaaaacaucugauggcagcacggcuaaccuggugcccgaggucaauaacgaaguuauggcccucgagccuguggugggggcggcuaucgccgccccggucgcuggacagcaaaaugugauugaccccuggaucagaaacaauuucguucaggccccuggcggggaauuuaccgugucuccccggaacgcuccuggagagauucugugguccgcgccccuuggcccugaucugaauccguaccucagccaccuggcccgcauguauaacggguacgccggaggcuucgaaguccaggugauccuugcuggcaaugccuuuacagcugggaagauuaucuucgccgcgguucccccuaacuuucccaccgagggacuguccccuucucaggugacaauguucccccauaucauugucgacgugagacaacucgagccggugcugaucccucugcccgauguccggaauaacuuuuaucacuacaaucagagcaacgacccuaccauuaaacucaucgccaugcuguauacaccccuucgcgcuaauaacgccggcgaugacguuuucaccguguccugcagagugcugacgcggcccagcccugauuuugacuucauuuuucucgucccgcccaccguggaaucucgcacaaagccuuucuccguucccauccugaccguggaggaaaugacaaacagcagauuuccuauuccccuugagaaacuguucaccgggccgucuuccgcuuucgucgugcagccucagaauggacgguguacgaucgauggcguucuccuggggacaacccaacugagccccgugaacaucugcacauuucgcggagacgucacccauauuaccggcucuagaaauuacacaaugaaccucgccacgcagaauuggaacuccuaugauccuaccgaggaaauccccgccccucugggcacacccgacuucguggggaagauucagggaguccuuacccagacaacccgggcugacggcagcacgcgcgggcacaaggcgacaguguacaccggauccgccgauuuugcuccgaaacugggcagaguucaauucgccaccgacacagauaaugacuuugaugccaaccagaauaccaaguucacaccugugggggucauccaggacggaaacacggcucaucggaaugagccccaacagugggugcuccccucuuacagcggccgcaacucccacaauguucaccuggccccugcgguggcuccgaccuuucccggcgaacagcuucuguucuuuagaagcacaaugccuggguguucuggauaucccaacauggaucucgacugccugcugccucaggaguggguccaauacuucuaucaggaagccgcccccgcucaguccgauguggcccuccugcgguuugugaauccugacaccggcagaguucuuuucgaguguaaacugcauaagagcggguacgucacaguggcucacaccggacagcaugaucucgugauucccccgaacggcuauuuucgcuucgacucuugggucaaccaauucuacacgcuggccccuauggggaauggcaccggacggagacgcuga

SEQ ID NO: 29631 - RNA, 1617 nt, Artificial Sequence
  derived and/or modified sequence opt5 from VP1__Norovirus_and/or_Norovirus-like__JN400620
augaagauggccagcaacgacgugaaucccuccgauggcucugcugccaaccuggucccugagguuaauaacgaagugauggcgcucgagccgguggucggggcugccaucgccgcucccguggccggacagcaaaauguuauugacccuuggaucagaaacaauuucgugcaggcucccggcggggaauuuaccgucagcccucggaacgcccccggagagauucugugguccgcgccucuuggcccggaucugaaucccuaccucucucaccuggcccgcauguauaacggguacgcuggaggcuucgaagugcagguuauccuugccggcaaugcuuuuacagccgggaaaauuaucuucgcggccgugccucccaacuuuccuacggagggacugagccccucccaggucaccauguucccgcauaucauuguggacgugagacaacucgagccuguccugaucccccugccugauguucggaauaacuuuuaucacuacaaucagucuaacgacagcacaauuaagcucaucgcuaugcuguauacaccccuucgcgccaacaaugcuggcgaagauguguucaccguguccugcagaguccugacccggcccagcccugacuuugauuucauuuuucucgugccgcccacaguugagucucgcaccaaaccuuucacggugcccauccugaccgucgaagagaugacaaacuccagauuuccuauuccccuugagaagcuguucaccgggccgagcucugccuucgugguucagccucagaauggacgguguacaaccgacggcgugcuccuggggacgacacaacugucccccgucaacaucugcaccuuucgcggagaugugacacauaucgccggcagcagaaauuacaccaugaaccucgcuucucugaauuggaacaauuaugacccuaccgaagagauucccgcgccucuuggcacacccgauuucgucgggaaaauccagggagugcugacgcagaccacaaagggcgacggguccacccggggacacaaggccacaguuuacaccggcagcgcuccguuuacgccuaaacucggguccgugcaguucucuacagacaccgaaaacgauuuugagacccaucaaaauacaaaguucacccccgucggagugauucaggacggcggcacaacgcaccgcaacgaaccccagcaauggguucugccuagcuacuccgggagagaugugccgaauguccaccuugcccccgccguggcuccuaccuuucccggagagcagcuccuguucuuucggagcacaaugccuggcuguucuggguaucccaacauggaccuggauugccugcucccucaggagugggugcagcauuucuaccaagaagccgcgcccgcucaguccgacguugcccugcuucgcuuugucaauccggauaccggaagagugcuguucgaguguaaacuccacaagagcggcuaugugacagucgcccauaccgggcagcacgaccuggugaucccucccaacggcuacuuucgguucgauucuuggguuaaccaguucuauacgcuugcuccuaugggaaauggcaccgggagacgccgguga

SEQ ID NO: 29632 - RNA, 1617 nt, Artificial Sequence
  derived and/or modified sequence opt5 from VP1__Norovirus_and/or_Norovirus-like__JQ613573
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccucuuccagaaacuacaccaugaaucucgccagccagaacuggaacuccuaugauccuaccgaggaaauccccgcuccgcugggcacaccugacuucgucggcaaaauucagggggugcuuacgcagaccacacggaccgacggaucuacacgcggccacaaggcgaccguuuacacggggagcgccgauuuuucccccaagcugggaagagugcaauucgcuacagacaccgauaaugacuuugagaccaaucagaacacaaaauucacccccgucggcgugauccaggaugggagcacaacgcaucggaaugaaccucaacaguggguucucccgucuuacuccggacgcaacauucacaaugugcaccuggcccccgccgucgcuccuaccuuucccggcgagcagcuucuguucuuuagaagcacaaugccuggcuguucuggguaucccaacauggaccucgauugccugcugccucaggaaugggugcaauacuucuaucaggaggccgcgcccgcucagagcgacguggcccuccugcgguuuguuaauccggauaccggaagaguccuuuucgaguguaagcugcauaaauccggcuacgugacaguggcccacaccgggcagcaugaccucgucaucccucccaacggauauuuucgcuucgauucuugggugaaccaauucuacacgcuggcuccuaugggcaaugggaccggccggagacgcuga

SEQ ID NO: 29633 - RNA, 1617 nt, Artificial Sequence
  derived and/or modified sequence opt5 from VP1__Norovirus_and/or_Norovirus-like__JQ478408
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaaaguucacgcccguuggcgugguccaggaugggaacggagcucaccaaaaugagccccagcagugggugcucccuuccuacagcggcagaaccgggcauaacguucaccuggccccggccguggcucccacauuuccuggagaacagcuucuguucuuucgguccaccaugcccggcuguucuggguacccuaacaugaaucucgacugccugcugccccaagaguggguccagcauuucuaucaggaggccgcgccugcucagagcgauguggcccuccugcgcuuugugaaccccgacacaggcagaguucuuuucgaauguaaacugcacaaguccggauacgucaccguggcccacacgggccaacaugaucucgugaucccgccuaauggguauuuucgguucgacagcugggucaaccaguucuacacccuggcucccaugggaaauggcacagggagacgccgguga

SEQ ID NO: 29634 - RNA, 1617 nt, Artificial Sequence
  derived and/or modified sequence opt5 from VP1__Norovirus_and/or_Norovirus-like__EF684915
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaaauggaauaaguaugacccuaccgaagagauucccgccccucuugggacacccgauuucgugggaaagauccagggcguccugacgcagaccacaaaaggggacggaucuacccggggccacaaggcuacaauuuacaccggguccgccccguuuacgccuaaacucggaagcgugcaguucuccacagacaccgaaaacgauuuugagacccaucaaaauacaaaguucacccccguuggcgugacacaggacggcucuacgacccaccgcaacgaaccccagcaauggguccugccuagcuacuccgggagaaaugugcacaacguucaucuugccccggcuguggcccccacauuuccuggagagcagcuccuguucuuucggagcaccaugcccggcuguucuggguauccuaauauggaucuggacugccugcucccccaggaguggguccagcacuucuaccaagaagcggcuccugcccaguccgauguggcccugcuucgcuuugugaaccccgacacaggaagaguucuguucgaguguaaacuccauaagagcggcuaugucaccguggcucacacggggcagcacgaucuggugaucccgccuaauggcuacuuucgguucgacucuugggucaaccaguucuauacccuugcccccaugggaaacggcacagggagacgccgguga

SEQ ID NO: 29635 - RNA, 1617 nt, Artificial Sequence
  derived and/or modified sequence opt5 from VP1__Norovirus_and/or_Norovirus-like__HQ456331
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagacacccgccccucuugggacgcccgauuucgugggaaaaauucagggcguccugacccagacaaccaagggggacggaucuacacggggccacaaggcuaccguguacacgggguccgccccguuuacaccuaaacucggaagcguucaguucuccaccgacaccgaaaacgauuuugagacacaucaaaauaccaaguucacacccgugggcgucauccaggacggcucuacgacccaccgcaacgaaccccagcaaugggugcugccuagcuacuccgggagaaauguucacaacgugcaucuugccccggcugucgcccccacauuuccuggagagcagcuccuguucuuucggagcaccaugcccggcuguucuggguauccuaauauggaucuggacugccugcucccccaggagugggugcagcacuucuaccaagaagcggcuccugcccaguccgauguggcccugcuucgcuuuguuaaccccgacacaggaagaguccuguucgaguguaaacuccauaagagcggcuaugugaccguggcucacacggggcagcacgaucuggucauuccgccuaacggcuacuuucgguucgacucuugggugaaucaguucuauacccuugcccccaugggaaacggcacagggagacgccgguga

SEQ ID NO: 29636 - RNA, 1617 nt, Artificial Sequence
  derived and/or modified sequence opt5 from VP1__Norovirus_and/or_Norovirus-like__HQ456322
augaagaucgccagcuccgacgcuaaccccucugauggcagcaccgccaaucuggugccugaggucaacaaugaaguuauggcgcucgagccgguggugggggcugccauugccgcucccgucgccggacagcaaaacgugaucgacccuuggauuagaaauaacuucguucaggcucccggcggggaauuuacaguguccccucggaaugcccccggagagauccuguggucugcgccucuuggcccggaucugaaccccuaccucagccaccuggcccgcauguauaauuccuacgcugggggauucgaaguccaggugauucuugccggcaacgcuuuuacggccggcaaaaucaucuucgcggccguuccucccaauuuuccuaccgaggggcugucucccagccaggugacaauguucccgcauauuaucgucgacgugagacaacucgagccugugcugauuccccugccugauguccggaacaauuuuuaucacuacaaccaguccaaugaccccaccaucaagcucauugcuaugcuguauacaccccuucgcgccaacaacgcuggagaugacguuuucaccgugagcugcagagugcugacacggccuucuccggauuuugacuucaucuuucucgugcccccuaccgucgaaucccgcacgaaacccuucagcguuccuauucugaccguggaggaaaugacaaauucuagauuucccaucccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauauugccuccacccaggaguacaccaugaaccucgcuagccagaauuggaacaauuaugaucccacagaagagaucccugcgccccugggaacgccggacuucgugggcaaaauucagggcguccuuacccaaacaaccagacgggacggguccacacgcggacacaaggccaccgugucuacgggcagcguucauuuuacaccuaagcuggggagaauccaguucuccaccgauaccagcaacgacuuugaaacaggacagaauacccgguucacacccgugggcgucgugcaagaugggucuacgacccaccagaacgagccccagcaguggguucucccuaauuacuccggacgcgacagccacaacgugcaucuggcuccggccgucgcccccucuuuuccuggcgaacaacuucuguucuuuagaagcacaaugcccggcuguuccggguacccuaauaugaaccucgauugccugcugccccaggagugggugcagcacuucuaucaggaggcugccccugcgcaaucugacguggcucuccugcgguuuguuaaucccgauaccggaagaguccuuuucgaauguaaacugcauaagagcggcuacgugacaguggcccacaccgggcagcacgaccucgucauuccgccuaacggauauuuucgcuucgauuccugggugaaccaguucuacacgcuggcccccaugggcaaugggaccggccggagacgcuga

SEQ ID NO: 29637 - RNA, 1617 nt, Artificial Sequence
  derived and/or modified sequence opt5 from VP1__Norovirus_and/or_Norovirus-like__HM802551
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcuccagaaccuaccggaugaaccucgccagccagaauuggaacaauuaugauccuacagaggaaauucccgcuccucugggcacgcccgacuucguggggaaaauccagggaaugcuuacccagacaaccaagggcgacggguccacacgcggacacaaggcgaccgucucuacgggcagcguggauuuuacaccgaaacugggguccguucaauucgccaccgacaccgauaacgacuuugagacaggacagaauaccagauucacaccugugggcgucauucaggauggcagcucuacgcaucggaacgaaccccaacagugggugcuccccgacuacuccgggcgcaccguucacaaugugcaccuggcuccugccgucgccccgacauuucccggagagcagcuucuguucuuuagaagcaccaugccuggcuguucuggguaccccaacauggaucucgacugccugcugccucaggaaugggugcaacauuucuaucaggaggcugcccccagccaguccgauguggcgcuccugcgguuuguuaauccugacacaggaagaguccuuuucgaguguaagcugcacaaagcuggcuacgugaccguggcccauacggggcagcacgaucucgucauucccccgaacggcuauuuucgcuucgacucuugggugaaucaauucuacacccuggccccuaugggaaacggcgcugggcggagacgcuga

SEQ ID NO: 29638 - RNA, 1617 nt, Artificial Sequence
  derived and/or modified sequence opt5 from VP1__Norovirus_and/or_Norovirus-like__HM802546
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcaccagaacauaccggaugaaccucgccucccagaauuggaacaauuaugauccuacggaggaaauucccgcuccucugggcacccccgacuucguggggaaaauccagggaaugcuuacacagaccacaaagggcgacgggagcacccgcggacacaaggcgacggucuccacaggcucuguggauuuuaccccgaaacuggggagcguucaauucgccaccgacacagauaacgacuuugagaccggacagaauacaagauucacgccugugggcgucauucaggauggcuccagcgcucaucggaacgaaccccaacagugggugcuccccgacuacucugggcgcaccguucacaaugugcaccuggccccugccgucgcuccgacauuucccggagagcagcuucuguucuuuagauccaccaugccuggcuguagcggguaccccaacauggaucucgacugccugcugccucaggaaugggugcaacauuucuaucaggaggccgcgcccucucagagcgauguggcucuccugcgguuuguuaauccugacacaggaagaguccuuuucgaguguaagcugcacaaagccggcuacgugaccguggcccauacggggcagcacgaucucgucauucccccgaacggcuauuuucgcuucgacuccugggugaaucaauucuacacccuggcuccuaugggaaacggcgccgggcggagacgcuga

SEQ ID NO: 29639 - RNA, 1617 nt, Artificial Sequence
  derived and/or modified sequence opt5 from VP1__Norovirus_and/or_Norovirus-like__GQ856453
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggcuauccuugccggcaaugcguuuacagccgggaaaauuaucuucgcugccgugccucccaacuuuccuacggagggacugagccccucccagguuaccauguucccgcauaucauuguggacgucagacaacucgagccugugcugaucccccugccugaugugcggaauaacuuuuaucacuacaaucagucuaacgacagcacaauuaagcucaucgcuaugcuguauacaccccuucgcgccaacaaugccggcgaagaugucuucaccguuuccugcagagugcugacccggcccagcccugacuuugauuucauuuuucucgugccgcccacagucgagucucgcaccaaaccuuucacggugcccauccugaccguugaagagaugacaaacuccagauuuccuauuccccuugagaagcuguucaccgggccgagcucugcuuucgugguccagccucagaauggacgguguacaaccgacggcgugcuccuggggacgacacaacugucccccguuaacaucugcaccuuucgcggagaugugacacauaucgcgggcagcagaaauuacaccaugaaccucgccucucugaauuggaacaauuaugacccuaccgaagagauucccgcuccucuuggcacacccgauuucgucgggaaaauccagggagugcugacgcagaccacaaagggcgacggguccacccggggacacaaggccacagucuacaccggcagcgccccguuuacgccuaaacucgggucccugcaguucucuacagacaccgaaaacgauuuugagacccaucaaaauacaaaguucacccccgugggaguuauucaggacggcggcacaacgcaccgcaacgaaccccagcaaugggugcuuccuagcuacuccgggagaaaugucccgaacgugcaccuggcucccgccguugcgccuaccuuucccggagagcagcuccuguucuuucggagcacaaugccuggcuguucuggguaucccaauauggaucuggacugccuccugccucaggagugggugcagcauuucuaccaagaagcugcccccgcccaguccgaugucgcucuccugcgcuuugugaacccggacaccggaagagugcuuuucgaguguaaacugcacaagagcggcuauguuacagucgcccauaccgggcagcacgaucuugugaucccucccaacggcuacuuucgguucgacucuugggugaaucaguucuauacgcuggcuccuaugggaaacggcaccgggagacgccgguga

SEQ ID NO: 29640 - RNA, 1617 nt, Artificial Sequence
  derived and/or modified sequence opt5 from VP1__Norovirus_and/or_Norovirus-like__GQ856445
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucaguccggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacguggaucuggacugccugcucccucaggagugggugcagcauuucuaccaagaagcggcucccgcccagagcgauguugcccugcuucgcuuugucaauccggacaccggaagagugcuguucgaguguaaacuccacaagucuggcuaugugacagucgcucauaccgggcagcacgaucuggugaucccucccaacggcuacuuucgguucgacagcuggguuaaccaguucuauacgcuugccccuaugggaaauggcaccgggagacgccgguga

SEQ ID NO: 29641 - RNA, 1617 nt, Artificial Sequence
  derived and/or modified sequence opt5 from VP1__Norovirus_and/or_Norovirus-like__AB541358
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucugauccuuaccguggaagagaugacaaacuccagauuucccauuccucuggagaaacucuucaccgggcccagcucugccuucgucgugcagccgcagaauggacgguguacaaccgacggcguucugcuggggacgacacaacucuccccugugaacaucugcaccuuucgcggagaugucacacauaucgcuggcagcagaaauuacaccaugaaccuggcgucucuuaauuggaacaauuaugaccccaccgaagagauuccugcuccccugggcacaccugauuucguggggaagauccagggaguccucacgcagaccacaaagggcgacggguccacccggggacacaaggccacaguguacaccggcagcgcccccuuuacgccgaaacugggguccguucaguucucuacagacaccgaaaacgauuuugagauucaucaaaauaccaaguucacaccugugggagucauccaggacggcagcaccacacaccgcaacgaaccccagcaaugggugcuucccuccuacagcggcagaaauguucacaacgugcaucuggccccugcugucgccccgacguuucccggggagcagcuccuguucuuucggucuaccaugccuggauguuccggcuaucccaauauggaucuggacugccuccugccucaggagugggugcagcacuucuaccaagaagcggcucccgcccagagcgauguggcccuucugcgcuuuguuaacccugacacagggagaguccucuucgaguguaaacugcauaagucuggauaugugaccguggcuuacacaggccagcacgaucuugucauucccccgaacggguauuuucgguucgacagcugggugaaucaguucuacacccuggccccuaugggcaacggaacgggcagacgccgguga

SEQ ID NO: 29642 - RNA, 1617 nt, Artificial Sequence
  derived and/or modified sequence opt5 from VP1__Norovirus_and/or_Norovirus-like__AB541349
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccacgccguuuacaccuaaacucggaagcguucaguucuccaccgacaccgaaaacgauuuugagacacaucaaaauaccaaguucacacccgugggcgucauucaggacggcucuacgauccaccgcaacgaaccccagcaaugggugcugccuagcuacuccgggagaaauguucagaacgugcaccuugccccggccgucgcucccaccuuuccuggagagcagcuccuguucuuucggagcacaaugcccggcuguucuggguauccuaauauggaucuggacugccugcucccccaggagugggugcaacauuucuaccaggaagccgcgccugcucaguccgauguggcccugcuucgcuuuguuaaccccgacaccggaagaguccuguucgaguguaaacuccacaagagcggcuaugugacaguggcccauaccgggcagcacgaucuggucauuccgccuaacggcuacuuucgguucgacucuugggugaaucaauucuauacgcuugcucccaugggaaacggcaccgggagacgccgguga

SEQ ID NO: 29643 - RNA, 1617 nt, Artificial Sequence
  derived and/or modified sequence opt5 from VP1__Norovirus_and/or_Norovirus-like__AB541342
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccuucuggcccggaucuuaaucccuaccugagccaccucgcucgcauguucaacgacuaugccgggggauuugaaguccaggugauccuggcuggcaaugccuucacggcgggcaaaauuaucuuugccgcuguuccucccaacuucccuaccgaggggcuuucccccucucaggugacaauguuuccgcauaucauugucgaugugagacagcuggagccugugcucaucccccugccugacguccggaauaacuucuaccacuauaaucaaagcaacgauuccaccauuaagcugaucgccaugcucuacacaccccugcgcgcuaacaaugccggagaagacguuuuuaccgugagcugcagagugcuuacacggcccucuccugauuucgacuuuauuuuccuggucccgcccaccguggagucccgcacgaaaccuuuuaccguucccauccucacaguggaagagaugaccaacagcagauucccuauuccccuggagaaacuuuucacaggcccgucuggggccuuugucgugcagccucagaauggacgguguaccacggauggcguucugcucgggacaacccagcugucccccgugaacaucugcacauuccgcggagacgucacccauaucgcuggcagcagaaauuauaccaugaaccuggcgucucucaauuggaacaauuacgauccuacagaagagauucccgccccucugggcacgcccgacuuuguggggaagauccaaggaguccuuacccagacaaccaagggcgacggguccacacggggacacaaggcuaccguguauacgggcagcgccccguucacaccuaaacugggguccguucaguuuucuaccgauaccgaaaacgacuucgaggcccaucagaauacaaaguuuacccccgugggagucauucaagauggcagcacaacgcaccgcaacgaaccccagcagugggugcucccuuccuacagcggcagaaauguucaaaacgugcaccuggcuccggccgucgcgcccaccuucccuggggagcagcuucuguuuuuccggucuacaaugcccggauguuccggcuacccuaauauggaccucgauugccugcugccccaggagugggugcagcauuuuuaucaagaagcugccccugcccagagcgacguggcucuccugcgcuucguuaaccccgauaccgggagaguccuuuuugaguguaaacugcacaagucuggauacgugacaguggcccauaccggccagcacgaccucgucaucccgccuaacggguauuuccgguucgauagcugggugaaucaguuuuacacgcuggcucccaugggcaacggaaccggcagacgccgguga

SEQ ID NO: 29644 - RNA, 1617 nt, Artificial Sequence
  derived and/or modified sequence opt5 from VP1__Norovirus_and/or_Norovirus-like__AB541248
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacagcuacgccgggggauucgaaguccaggugauccuugcuggcaaugccuuuacagcgggcaaaauuaucuucgccgcuguuccucccaacuuuccuacggaggggcugucccccucucaggugaccauguucccgcauaucauugucgacgugagacaacucgagccugugcugaucccccugccugauguccggaauaacuuuuaucacuacaaucagagcaacgacuccacaauuaagcucaucgccaugcuguauacaccccuucgcgcuaacaaugccggagaagauguuuucaccgugagcugcagagugcugacccggcccucuccugacuuugauuucauuuuucucgucccgcccacaguggagucccgcaccaaaccuuucacgguucccauccugaccguggaagagaugacaaacagcagauuuccuauuccccuugagaagcuguucaccggcccgucuuccgccuucgucgugcagccucagaaugggcgguguacaaccgacggaguucuccugggcacgacacaacugagccccgugaacaucugcaccuuucgcggggaugucacacauaucgcuggaucuagaaauuacaccaugaaccucgcgucccugaauuggaacaauuaugacccuaccgaagagauucccgccccucuuggcacacccgauuucgugggcaaaauccaggggguccugacgcagaccacaaagggagacggcagcacccgggggcacaaggcuacaguguacaccggauccgccccguuuacgccuaaacucggcucuguucaguucagcacagacaccgaaaacgauuuugagacccaucaaaauacaaaguucacccccgugggggucauucaggacggaggcacaacgcaccgcaacgaaccccagcaaugggugcugccuuccuacagcggcagagauguucacaaugugcaucuugccccggcugucgcccccaccuuuccuggggagcagcuccuguucuuucggucuacaaugcccggauguuccggcuauccuaacauggaccuggauugccugcucccccaggagugggugcagcacuucuaccaagaagcggcuccugcccagagcgacguggcccugcuucgcuuuguuaaucccgauaccgggagaguccuguucgaguguaaacuccauaagucuggauaugugacaguggcucacaccggccagcacgaccuggucaucccgccuaacggguacuuucgguucgauagcugggugaaccaguucuauacgcuugcccccaugggcaauggaaccggcagacgccgguga

SEQ ID NO: 29645 - RNA, 1617 nt, Artificial Sequence
  derived and/or modified sequence opt5 from VP1__Norovirus_and/or_Norovirus-like__GQ246798
augaagauggccagcuccgacgcuaaccccuucgauggcucuaccgccaaucuggugccugaggucaacaaugaaguuauggcgcucgagccgguggugggggcugccaucgccgcucccgucgccggacagcaaaacgugauugacccuuggaucagaaauaacuuuguucaggcucccggcggggaguucacagugagcccucggaaugcccccggagaaauucugugguccgcgccucuuggcccggaucugaaccccuaccucucucaccuggcccgcauguauaauggguacgcuggaggcuuugaaguccaggugauccuugccggcaacgcuuucacggccgggaaaauuaucuuugcggccguuccucccaauuucccuaccgagggacugagccccucccaggugacaauguuuccgcauaucauugucgacgugagacaacucgagccugugcugaucccccugccugauguccggaacaauuucuaucacuacaaccagucuaaugaccccaccauuaagcucaucgcuaugcuguauacaccccuucgcgccaacaacgcuggcgaugacguuuuuaccgugagcugcagagugcugacacggccuuccccggauuucgacuuuauuuuccucgugcccccuaccgucgaaagccgcacgaaacccuuuucuguuccuauccugaccguggaggaaaugacaaauuccagauuccccauuccgcuugagaagcuguucaccgggccuagcucugccuuugucgugcagccccagaacggacgguguacaaccgauggcguucuccuggggacgacacaacuguccccugugaauaucugcaccuuccgcggagacgucacacauaucaccggcagcagaaacuacaccaugaaucucgccacacagaacuggaacucuuaugaucccacggaggaaauuccugcuccccugggcaccccggacuuuguggggaaaauccagggaguccuuacacagaccacacgggcggacggcuccacccgcgggcacaaggccacgguguacacaggaagcgcugauuucgccccuaagcugggcagaguucaauuugccaccgacaccgauaaugacuucgaugcuaaucagaacacaaaauuuacccccgugggggucauucaggacggaaauacagcccaucggaacgagccccaacagugggugcucccuuccuacucuggccgcaauagccacaacguucaccuggcgccggcuguggcccccacguucccuggcgaacagcuucuguuuuucagauccaccaugcccggguguagcggauauccuaauauggaucucgacugccugcugccccaggaguggguccaauacuuuuaucaggaagccgcuccugcccagucugauguggcucuccugcgguucgugaaccccgacacaggcagaguucuuuuugaguguaagcugcauaaauccggguacgucaccguggcccacacaggacagcaugaucucgugaucccgccuaacggcuauuuccgcuucgacagcugggucaaucaauuuuacacccuggcgcccauggggaacggcacgggacggagacgcuga

SEQ ID NO: 29646 - RNA, 1617 nt, Artificial Sequence
  derived and/or modified sequence opt5 from VP1__Norovirus_and/or_Norovirus-like__GQ246791
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgagaaucauugucgacgugcggcaacucgagccugugcugaucccccugccugauguccgcaauaacuuuuaucauuacaaucagucuaacgaccccaccauuaagcucaucgcuaugcuguauacaccccuuagagccaacaaugcuggcgaugacguuuucaccgugagcugccgggugcugacacgcccuuccccggauuuugacuucauuuuucucgugcccccuaccgucgaaagcagaacgaaacccuucaccguuccuauccugacaguggaggaaaugaccaacucucgguuucccauuccgcuugagcgccuguacacagggccuuccagcgccuucgucgugcagccccagaauggaagauguaccacggauggcguucuccuggggacaacccaacugucugccgugaacaucugcacauuccggggagacgucacccacaucgcuggcucccgcaauuauaccaugaaccucgcgagccagaauuggaacaauuacgauccuacagaggaaauucccgccccucugggcacgcccgacuuuguggggaagauccagggaaugcuuacccagacaaccagaucugacggcuccacacgggggcauaaagcuaccguccugacgggaagcgccgauuucgccccgaagcucggccgcgugcaauuugcuacagacaccgauaacgacuucgaguccgggcagaauaccaaguuuacaccuguuggagugauucaggauggcucuaccacacacagaaacgaaccccaacaguggguccugcccaauuacagcggccggacggggcauaacgugcaccuugccccugcgguugcuccgaccuaucccggagagcagcuccuguucuuuagauccacaaugccuggcuguagcggguaccccaauauggaccuggauugccugaucccucaggacugggugcaacacuucuaucaggaagccgcccccgcucagucugaugucgcccuccugcgcuuugugaacccugacaccggacgggugcuuuucgaguguaaacugcauaaguccggcuacguuacagucgcucacaccgggcagcaugaucucgugauucccccgaacggcuauuuuagauucgacagcugggugaaucaauuuuacacgcuggccccuaugggaaacggcaccgggcgccggagauga

SEQ ID NO: 29647 - RNA, 1617 nt, Artificial Sequence
  derived and/or modified sequence opt5 from VP1__Norovirus_and/or_Norovirus-like__GU350225
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggggucuguucaauucgccaccgacacagauaacgacuuugagaccggacagaauacaagauucacgcccgugggcgucauucaggauggcagcuccacccaucggaacgaaccccaacagugggugcucccugacuacagcgggcgcacagcucacaauguucaccuggccccggccguggcucccaccuuuccuggagagcagcuucuguucuuuagaucuacaaugcccggcuguuccggguacccuaacauggaucucgacugccugcugccccaggaauggguccaacauuucuaucaggaggccgcgccuagccagucugauguggcucuccugcgguuugugaaucccgacaccggaagaguucuuuucgaguguaagcugcacaaagccggcuacgucacgguggcccauaccgggcagcacgaucucgugaucccgccuaacggcuauuuucgcuucgacagcugggucaaucaauucuacacacuggcucccaugggaaacggcgccgggcggagacgcuga

SEQ ID NO: 29648 - RNA, 1617 nt, Artificial Sequence
  derived and/or modified sequence opt5 from VP1__Norovirus_and/or_Norovirus-like__AB504319
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagaggucacaaacuccagauuuccuauuccccuugagaagcuguucaccgggccgagcggagccuucgugguucagccucagaauggccgguguacaaccgacggggugcuccugggaacgacacaacugucucccgucaacaucugcaccuuucgcggcgaugugacacauaucgcuggcaccagaaauuacaccaugaaccucgcgucccugaauuggaacaauuaugacccuacagaagagauucccgccccucuugggacgcccgauuucgucggaaaaauccagggcgugcugacccagacaaccaagggggacggaagcacacggggccacaaggcuaccguuuacacggggucugccccguuuacaccuaaacucggauccgugcaguucagcaccgacaccgaaaacgauuuugagacacaucaaaauaccaaguucacacccgucggcgugauucaggacggcgggacgacccaccgcaacgaaccccagcaauggguucugccuuccuacucuggaagaaaugugcacaacguccaucuugccccggcuguggcccccacauuuccuggcgagcagcuccuguucuuucggagcaccaugcccggguguuccggauauccuaauauggaucuggacugccugcucccccaggagugggugcagcacuucuaccaagaagcggcuccugcccagagcgauguugcccugaugcgcuuugucaaccccgacacaggcagagugcuuuucgaguguaaacugcauaagucuggguaugugaccgucgcucacacgggccagcacgaucucgugaucccgccuaacggauacuuucgguucgacuccuggguuaaucaguucuauacccuggcccccaugggcaacgggacaggaagacgccgguga

SEQ ID NO: 29649 - RNA, 1617 nt, Artificial Sequence
  derived and/or modified sequence opt5 from VP1__Norovirus_and/or_Norovirus-like__AB447458
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccggcccuuccagcgccuucgugguucagccccagaacgggcgguguacaaccgauggagugcuccugggcacgacacaacugucuccugucaauauuugcaccuuucgcggggacgugacacauaucgccggaacccaggaguacaccaugaaccucgcuucccagaauuggaacaauuaugaucccacagaagagaucccugcgccccugggcacgccggacuucgucggcaaaauucagggggugcuuacccaaacaaccagacgggacggaagcacacgcggccacaaggccaccguuuccacggggucugugcauuuuacaccuaagcugggaagaauccaguucagcaccgauaccuccaacgacuuugaaacaggccagaauacccgguucacacccgucggggugguucaagauggaggcacgacccaccagaacgagccccagcagugggugcucccuaauuacagcggccgcgacucucacaacguccaucuggcuccggccguggcccccuccuuuccuggggaacaacuucuguucuuuagaagcacaaugcccggauguucuggcuacccuaauaugaaccucgauugccugcugccccaggagugggugcagcacuucuaucaggaggcugccccugcgcaaagcgacguugcucuccugcgguuugucaaucccgauaccgggagagugcuuuucgaauguaaacugcauaaguccggauacgugacagucgcccacaccggccagcacgaccucgugauuccgccuaacggguauuuucgcuucgauucuuggguuaaccaguucuacacgcuggcccccaugggcaauggaaccggccggagacgcuga

SEQ ID NO: 29650 - RNA, 1617 nt, Artificial Sequence
  derived and/or modified sequence opt5 from VP1__Norovirus_and/or_Norovirus-like__AB385640
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccugucccgcauguauaauucuuacgccgggggauucgaaguccaggugauccuugcuggcaacgccuuuacggcuggcaaaauuaucuucgccgcgguuccucccaauuuuccuaucgaggggcugagccccucccaggugaccauguucccgcauauuaucgucgacgugagacaacucgagccugugcugauuccccugccugauguccggaacaauuuuuaucacuacaaccagagcaaugaccccacaaucaagcucauugccaugcuguauacaccccuucgcgcuaacaacgccggagaugacguuuucaccgugucuugcagagugcugacccggccuuccccggauuuugacuucaucuuucucgugcccccuacagucgaaagccgcaccaaacccuucucuguuccuauucugacgguggaggaaaugaccaauuccagauuucccacaccggucgagaaacuuuucaccggcccuagcucugcuuucaucgugcagccccagaacgggcgguguacaaucgauggaguucugcucggcaccacgcaacuguccccugugaauauuugcacauuucgcggggacgucacccauaucgccggaacacaggaguacaccaugaaccuggccagccagaauuggaacaauuaugaucccaccgaagagauuccugcuccccucggcacaccggacuucgugggcaagauccaggggguccugacgcaaaccacaagacgggacggauccacccgcggccacaaggcgacagugucuaccgggagcguucauuuuacgccuaaacuuggacggauucaguucuccacagauaccagcaacgacuuugaaaccagacagaauacacgcuucacccccgugggcgucauccaagaugggucuacaacgcaccagaacgagccccagcagugggugcugccuaauuacuccggaagagacagccacaacguucaucucgccccggcuguggcccccucuuuuccuggcgaacaacugcuuuucuuucggagcaccaugcccggcuguuccggguacccuaauaugaaccuggauugccuccugccccaggaguggguccagcacuucuaucaggaggccgcuccugcccaaucugacguggcgcugcucagauuugugaaucccgauacaggacgcguuauguucgaauguaagcugcauaagagcggcuacaucaccgucgcucacacagggcagcacgaccuugugauuccgccuaacggauauuuucgguucgaugccugggugaaccaguucuacacccuggcccccaugggcaaugggacgggcagacgccgguga

SEQ ID NO: 29651 - RNA, 1617 nt, Artificial Sequence
  derived and/or modified sequence opt5 from VP1__Norovirus_and/or_Norovirus-like__AB385633
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuguuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugacuccaccaucaagcucauugcuaugcuguauacaccccuucgcgccaacaacgcuggcgaugacguguucaccgugagcugcagaguccugacacggcccucuccugauuuugacuucaucuuucucgugccgcccaccguugaaucccgcacgaaaccuuucagcgugcccauucugaccgucgaggaaaugacaaauucuagauuuccuaucccccuugagaagcuguucaccgggccguccagcgccuucauugugcagccucagaacggacgguguacaaccgauggcguucuccuggggacgacacaacugucucccgugaauaucugcaccuuucgcggagacgucacacauaucgccggcacccaggaguacaccaugaaccucgcuucccagaauuggaacaauuaugauccuacagaagagauucccgcgccucugggcacgcccgacuucguggggaaaauccagggaguccuuacccaaacaaccagacgggacggcagcacacgcgggcacaaggccaccguguccacgggaucuguucauuuuacaccgaagcugggcagaauccaguucagcaccgauaccuccaacgacuuugaaacagggcagaauacccgguucacaccugugggagucgugcaagauggcagcacgacccaccagaacgagccccagcaguggguucuccccaauuaccugggccgcgacucucacaacgugcaucuugcuccugccgucgccccguccuuucccggggaacaacuccuguucuuuagaagcacaaugccuggauguucuggcuaccccaauaugaaccuggauugccugcucccucaggagugggugcagcacuucuaucaggaggcugcccccgcgcaaagcgacguggcucugcuucgguuuguuaauccugauaccgggagaguccuguucgaauguaaacuccauaaguccggauacgugacaguggcccacaccggccagcacgaccuggucauucccccgaacggguauuuucgcuucgauucuugggugaaccaguucuacacgcuugccccuaugggcaauggaaccggccggagacgcuga

SEQ ID NO: 29652 - RNA, 1617 nt, Artificial Sequence
  derived and/or modified sequence opt5 from VP1__Norovirus_and/or_Norovirus-like__DQ658413
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccgacacccacaauuacacaaugaaccucgcuucucagaauuggaacaauuaugaucccacggaagagauuccugcgccccugggcaccccggacuucguggggaaaauccagggaaugcuuacacagaccacaagaggcgacggguccacccggggacauaaggccacggucagcacaggcgaugugcacuuuaccccuaagcuggggucuauucaauucaacaccgacacaaauaacgauuuugaaaccggacagaauacaaaauucacgcccguuggcgugguccaggacggcaacgggacccaccaaaaugagccccagcagugggugcucccuuccuacagcggacgcacaggccauaacguucaccuggcuccggccguggcccccaccuuuccuggggaacagcuucuguucuuuagauccacaaugcccggauguucuggcuacccuaacaugaaucucgauugccugcugccccaagaguggguccagcauuucuaucaggaggcugccccugcgcagagcgacguggcucuccugcgguuugugaaccccgauaccgggcgcguucuuuucgaauguaagcugcacaaauccggcuacgucacgguggcccacaccggacaacaugaccucgugaucccgccuaauggcuauuuuagauucgauagcugggucaaccaguucuacacacuggcccccauggggaauggaaccggccggagacgcuga

SEQ ID NO: 29653 - RNA, 1617 nt, Artificial Sequence
  derived and/or modified sequence opt5 from VP1__Norovirus_and/or_Norovirus-like__AB220923
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcaccagaacauaccggaugaaccucgccucccagaauuggaacaauuaugauccuacggaggaaauucccgcuccucugggcacccccgacuucguggggaaaauccagggaaugcuuacacagaccacaaagggcgacgggagcacccgcggacacaaggcgacggucuccacaggcucuguggauuuuaccccgaaacuggggagcguucaauucgccaccgacacagauaacgacuuugagaccggacagaauacaagauucacgccugugggcgucauucaggauggcuccagcacccaucggaacgaaccccaacagugggugcuccccgacuacucugggcgcacaguucacaaugugcaccuggcuccugccgucgccccgaccuuucccggagagcagcuucuguucuuuagauccacaaugccuggcuguagcggguaccccaacauggaucucgacugccugcugccucaggaaugggugcaacauuucuaucaggaggcugcccccucucagagcgauguggcgcuccugcgguuuguuaauccugacaccggaagaguccuuuucgaguguaagcugcacaaagcuggcuacgugacgguggcccauaccgggcagcacgaucucgucauucccccgaacggcuauuuucgcuucgacuccugggugaaucaauucuacacacuggccccuaugggaaacggcgcugggcggagacgcuga

SEQ ID NO: 29654 - RNA, 1617 nt, Artificial Sequence
  derived and/or modified sequence opt5 from VP1__Norovirus_and/or_Norovirus-like__AY588016
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaaaguucacgcccguuggcgugguccaggaugggaacggaacccaccaaaaugagccccagcagugggugcucccuuccuacagcggcagaacagggcauaacguucaccuggcuccggccguggcccccaccuuuccuggagaacagcuucuguucuuucgguccgcuaugcccggcuguucuggguacccuaacaugaaucucgacugccugcugccccaagaguggguccagcauuucuaucaggaggccgcgccugcucagagcgauguggcccuccugcgcuuugugaaccccgacacaggcagaguucuuuucgaauguaaacugcacaaguccggauacgucaccguggcccacacgggccaacaugaucucgugaucccgccuaauggguauuuucgguucgacagcugggucaaccaguucuacacccuggcucccaugggaaauggcacagggagacgccgguga

SEQ ID NO: 29655 - RNA, 1617 nt, Artificial Sequence
  derived and/or modified sequence opt5 from VP1__Norovirus_and/or_Norovirus-like__AY502022
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaaaguucacgcccguuggcgugguccaggaugggaacggaacccaccaaaaugagccccagcagugggugcucccuuccuacagcggcagaacagggcauaacguucaccuggcuccggccguggcccccaccuuuccuggagaacagcuucuguucuuucgguccacaaugcccggcuguucuggguacccuaacaugaaucucgacugccugcugccccaagaguggguccagcauuucuaucaggaggcugccccugcgcagagcgauguggcucuccugcgcuuugugaaccccgacaccggcagaguucuuuucgaauguaaacugcacaaguccggauacgucacgguggcccacaccggccaacaugaucucgugaucccgccuaauggguauuuucgguucgacagcugggucaaccaguucuacacacuggcccccaugggaaauggcaccgggagacgccgguga

SEQ ID NO: 29656 - RNA, 1617 nt, Artificial Sequence
  derived and/or modified sequence opt5 from VP1__Norovirus_and/or_Norovirus-like__KX158280
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaucuaccacacaccggaaugagccccaacaguggguccucccuagcuacuccggccgcaacacgccgaaugugcaccuggcucccgccguggcgccuaccuuucccggcgaacagcuucuguucuuuagaagcacaaugccuggguguucuggauaucccaacauggaccucgauugccugcugccucaggaguggguucaauacuucuaucaggaggcugcccccgcccaguccgacgucgcucuccugcgguuugugaauccggauaccggcagagugcuuuucgaauguaagcugcauaaaagcggguacgucacaguggcccacaccggacagcaugaccucguuauuccucccaacggcuauuuucgcuucgauucuugggugaaccaauucuacacgcuggcuccuauggggaauggcaccggacggagacgcuga

SEQ ID NO: 29657 - RNA, 1617 nt, Artificial Sequence
  derived and/or modified sequence opt5 from VP1__Norovirus_and/or_Norovirus-like__KX371606
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaucuaccacacaccggaaugagccccaacaguggguccucccuagcuacuccggccgcaacacgcacaaugugcaucuggcuccggccguggcgcccaccuuuccuggcgaacagcuucuguucuuuagaagcacaaugcccggguguucuggauauccuaacauggaccucgauugccugcugccccaggaguggguucaauacuucuaucaggaggcugccccugcccaguccgacgucgcucuccugcgguuugugaaucccgauaccggcagagugcuuuucgaauguaagcugcacaaaagcggguacgucacaguggcccauaccggacagcacgaccucguuauuccgccuaacggcuauuuucgcuucgauucuugggugaaccaauucuacacgcuggcucccauggggaauggcaccggacggagacgcuga

SEQ ID NO: 29658 - RNA, 1617 nt, Artificial Sequence
  derived and/or modified sequence opt5 from VP1__Norovirus_and/or_Norovirus-like__KX371605
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagagcaccaaauucacacccguuggggugauccaggauggauccaccacacaccggaaugagccccaacaguggguccucccuagcuacucuggccgcaacacgccgaaugugcaccuggcucccgccguggcgccuaccuuucccggcgaacagcuucuguucuuuagauccacaaugccuggguguagcggauaucccaacauggaccucgauugccugcugccucaggaguggguucaauacuucuaucaggaggcugcccccgcccagucugacgucgcucuccugcgguuugugaauccggauaccggcagagugcuuuucgaauguaagcugcauaaaagcggguacgucacaguggcccacaccggacagcaugaccucguuauuccucccaacggcuauuuucgcuucgauuccugggugaaucaauucuacacgcuggcuccuauggggaacggcaccggacggagacgcuga

SEQ ID NO: 29659 - RNA, 1617 nt, Artificial Sequence
  derived and/or modified sequence opt5 from VP1__Norovirus_and/or_Norovirus-like__KX354128
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggacugcucacgcagaccacaaagggcgacggguccacccggggacacaaggcuacagucuacaccggcagcgccccguuuacgccuaaacugggguccgugcaguucgaaacagacaccgagaacgauuuugaaacccaucaaaauacaaaguucacccccguuggagugauucaggacggcggcacaacgcaccgcaacgagccccagcaauggguccuuccuucuuacagcgggagaaaugugccgaacguucaccuggcccccgcuguggccccuaccuuucccggagagcagcuccuguucuuucgguccacaaugccuggcuguagcggguaucccaauauggaucuggacugccuccugccucaggaauggguccagcauuucuaccaagaggcggcucccgcccagucugauguggcccuucugcgcuuugugaacccggacaccggaagaguucucuucgaauguaaacugcacaaguccggcuaugucacaguggcucauaccgggcagcacgaucuugugaucccucccaacggcuacuuucgguucgacagcugggucaaucaguucuauacgcuggccccuaugggaaacggcaccgggagacgccgguga

SEQ ID NO: 29660 - RNA, 1617 nt, Artificial Sequence
  derived and/or modified sequence opt5 from VP1__Norovirus_and/or_Norovirus-like__KX354099
augaagauggccagcuccgacgcuucucccagcgauggcuccgccgcgucucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccgugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacagcggggaaaguuauuuucgccgcugugccucccaauuuuccuacggagggacugagccccucccaggucaccauguucccgcauaucgugguggacgucagacaacucgagccuguucugaucccccugccugaugugcggaacaauuuuuaucacuacaaccagcucaaugaccccacaauuaagcugaucgccaugcuuuauacaccccugcgcgcuaacaaugccggcgaugacguguucaccgucagcugcagagugcucacccggccuucuccggauuuugacuucauuuuucugguucccccuacaguggaaucccgcaccaaacccuucagcgucccugugcuuacgguugaggaaaugaccaacucuagauuucccaucccgcuggagaagcuguucacagggccuuccagcgccuucgugguccagccccagaacggacgguguaccacagauggcgugcugcuggggaccacgcaacucucuccugucaauauuugcacauuucgcggagacgugacccauaucacaggcucccacaacuacaccaugaaucuggcuagccagaacuggaauaacuaugaucccaccgaggaaauuccugcgccccuuggcacaccggacuucguugggaaaauccagggagugcugacgcagaccacaagagccgacggcuccacccgggggcauaaggcuacagucuacaccggaucugccgauuuugccccuaagcucggccgcgugcaauucgagacggacacagaucacgacuuugaaaccaaucagaacaccaaauucacacccguuggggugauccaggauggaggcaccacacacagaaaugagccccaacaguggguccugccuagcuacuccggccggaacacgcauaaugugcaccuugcuccggccguggcgcccaccuuuccuggggaacagcuccucuucuuucgcagcacaaugcccggauguucuggcuauccuaacauggaccuggauugccugcucccccaggaguggguucaauacuucuaucaggaggcugccccugcccaguccgacgucgcucugcuuagauuugugaaucccgauaccgggcgggugcuguucgaauguaagcuccauaaaagcggauacgucacaguggcccacaccggccagcacgaccugguuauuccgccuaacggguauuuuagauucgauucuugggugaaucaauucuacacgcuugcucccaugggcaacggagccggccgccggagauga

SEQ ID NO: 29661 - RNA, 1617 nt, Artificial Sequence
  derived and/or modified sequence opt5 from VP1__Norovirus_and/or_Norovirus-like__KX354087
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaacuguucacgguuccuauccuuaccguggaggaaaugacaaacuccagauuucccauuccucuggagaaacucuucaccgggcccagcucugccuucgucgugcagccgcagaauggacgguguacaaccgauggcguucugcuggggacgacacaacucuccccugugaacaucugcaccuuucgcggagacgucacacauaucgcuggcagcagaaauuacaccaugaaccuggcgucucuuaauuggaacaauuaugaucccaccgaggaaauuccugcuccccugggcacaccugacuucguggggaagauccagggaguccucacgcagaccacaaagggcgacggguccacccggggacacaaggcuacaguguacaccggcagcgccgauuuuacgcccaaacugggguccguucaguucgccacagacaccgagaacgauuuugaaauucaucaaaauacccgcuucacaccggugggagucauccaggacggcggcaccacacacagaaacgagccucagcaaugggugcuucccucuuacagcgggcggaauguucacaacgugcaucuggcucccgccgucgcgccuaauuuuccgggagaacagcuccuguucuuucgcuccacgaugcccggcuguagcggguauccuaacauggaucuggacugccuccugccccaggagugggugcagcacuucuaccaagaggcugccccugcccagucugauguggcccuucugagauuuguuaaccccgacaccggacggguccucuucgaauguaagcugcauaaauccggcuaugugacaguggcccacaccgggcaguacgaucuugucauuccucccaauggcuauuuuagauucgacagcugggugaaccaguucuacacacuggcuccgaugggaaauggcaccgggcgccggagauga

SEQ ID NO: 29662 - RNA, 1617 nt, Artificial Sequence
  derived and/or modified sequence opt5 from VP1__Norovirus_and/or_Norovirus-like__KX354009
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaugaccccacaaucaagcucauugccaugcuguauacaccccuucgcgcuaacaacgccggcgaugacguguucaccguguccugcagaguccugacccggccuagcccggauuuugacuucaucuuucucgugcccccuacaguugaaucucgcaccaaacccuucuccgugccuguccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggaauaacuaugaucccaccgaggaaaucccugcgccccugggcacaccggacuucguggggaaaauccagggaguucuuacgcagaccacacggaccgacggcagcacacgcgggcacaaggccaccguguacacgggauccgcugauuuugccccuaagcugggcagaguccaauucgagacagacaccgaucaugacuuugaagccaaucagaacaccaaauucacacccguggggguuauucaggauggaucuaccacacaccggaaugagccccaacagugggugcucccuagcuacuccggccgcaacacgcacaauguccaucuggcuccggccguggcgcccaccuuuccuggcgaacagcuucuguucuuuagaagcacaaugcccggguguucuggauauccuaacauggaccucgauugccugcugccccaggagugggugcaauacuucuaucaggaggcugccccugcccaguccgacguugcucuccugcgguuugucaaucccgauaccggcagagugcuuuucgaauguaagcugcacaaaagcggguacgugacagucgcccauaccggacagcacgaccucgugaucccgccuaacggcuauuuucgcuucgauucuuggguuaaccaauucuacacgcuggcucccauggggaauggcaccggacggagacgcuga

SEQ ID NO: 29663 - RNA, 1617 nt, Artificial Sequence
  derived and/or modified sequence opt5 from VP1__Norovirus_and/or_Norovirus-like__KR131784
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaauauggcuucccagaacuggaauaacuaugaucccaccgaggaaauuccugcgccccucggcacaccggacuucguugggaaaauccagggagugcugacgcagaccacacggaccgacggcagcacacgcgggcacaaggccaccgucuacacgggauccgcugauuuugccccuaaacuuggcagagugcaauucgagacagacaccgaucaugacuuugaagccaaucagaacaccaaguucacacccguuggggugauccaggauggaucuaccacacaccggaaugagccccaacaguggguccugccuagcuacuccggccgcaacacgcacaaugugcaucucgcuccggccguggcgcccaccuuuccuggcgaacagcugcuuuucuuuagaagcacaaugcccggguguucuggauauccuaacauggaccuggauugccuccugccccaggaguggguucaauacuucuaucaggaggcugccccugcccaguccgacgucgcucugcuccgguuugugaaucccgauaccggcagagugcuguucgaauguaaacuucacaagagcggguacgucacaguggcccauaccggacagcacgaccugguuauuccgccuaacggcuauuuucgcuucgauucuugggugaaccaauucuacacgcucgcucccauggggaauggcaccggacggagacgcuga

SEQ ID NO: 29664 - RNA, 1617 nt, Artificial Sequence
  derived and/or modified sequence opt5 from VP1__Norovirus_and/or_Norovirus-like__AB972527
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaagcaccacacaucgcaacgagccccaacaguggguccucccuuccuacagcggcagauauacgccgaaugugcaccuggcucccgccguggcgccuaccuuucccggcgaacagcuucuguucuuucggucuacaaugccuggguguuccggauaccccaacauggaccucgauugccugcugccucaggaguggguucaauauuucuaccaggaggcugcccccgcccagagcgacgucgcucuccugagauuugugaauccggauaccggccgcgugcuuuucgaauguaagcugcacaaaucuggguaugucacaguggcccauaccggacagcacgaccucguuauuccucccaacggcuacuuucgguucgauagcugggugaaucaauucuauacgcuggcuccuauggggaacggcaccggaagacgccgguga

SEQ ID NO: 29665 - RNA, 1617 nt, Artificial Sequence
  derived and/or modified sequence opt5 from VP1__Norovirus_and/or_Norovirus-like__AB972525
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucgaaacagacaccgagaacgauuuugaaacccaucaaaauacaaaguucacccccguuggagugauucaggacggcggcacaacgcaccgcaacgagccccagcaauggguccugccuucuuacagcgggagaaaugugccgaacguucaccuugcccccgcuguggccccuaccuuucccggagagcagcuccuguucuuucgguccacagucccuggcuguagcggguaucccaauauggaucuggacugccugcucccucaggaaugggugcagcauuucuaccaagaggcggcucccgcccagucugauguggcccugcuucgcuuuguuaacccggacaccggaagaguccuguucgaauguaaacuccacaaguccggcuaugugacaguggcucauaccgggcagcacgaucuggucaucccucccaacggcuacuuucgguucgacagcugggugaaucaguucuauacgcuugccccuaugggaaacggcaccgggagacgccgguga

SEQ ID NO: 29666 - RNA, 1617 nt, Artificial Sequence
  derived and/or modified sequence opt5 from VP1__Norovirus_and/or_Norovirus-like__KT780388
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauacaaccggcucucacaacuacaccaugaaucucgcuucccagaacuggagcaauuaugaucccacagaggaaaucccugcgccccugggcacgccggacuucguugggaaaauucagggagugcuuacccagacaaccagaacagacggcuccacccgggggcauaaggccacggucuacacaggaucugcugauuuugccccuaagcugggccgcgugcaauucgccaccgacaccgaucacgacuuugaggcuaaccagaauacaaaauucacccccguuggggugauccaggauggaggcacaacgcacagaaacgaaccccaacaguggguccucccuagcuacuccggccggaauaccccgaacgugcaucuggcccccgcgguggcuccuacauuucccggggagcagcuucuguucuuucgcagcaccaugccuggauguucuggcuaucccaauauggaccucgauugccugcugccucaggaauggguucaauacuucuaucaggaggccgcccccgcucaguccgacgucgcccuccugagauuugugaacccggauacagggcgggugcuuuucgaguguaagcugcacaaaagcggauacgucaccguggcucauacgggccagcacgaccucguuaucccucccaauggguauuuuagauucgauucuugggugaaccaauucuacacccuggccccuaugggcaacggaacaggccgccggagauga

SEQ ID NO: 29667 - RNA, 1617 nt, Artificial Sequence
  derived and/or modified sequence opt5 from VP1__Norovirus_and/or_Norovirus-like__KT780373
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgccacagacaccgaucacgacuuuguugcuaaccagaauaccaaauucacacccgugggggucauccaggauggaggcaccacacacagaaacgagccccaacagugggugcucccuagcuacuccggccggaauacgccgaacgugcaucuggcccccgcgguugcuccuaccuuucccggggaacagcuucuguucuuucgcagcacaaugccuggauguucuggcuaucccaauauggaccucgauugccugcugccucaggaguggguccaauacuucuaucaggaagccgcccccgcucaguccgacguggcccuccugagauuugugaacccggauaccgggcggguccuuuucgaguguaagcugcacaaaagcggauacgugacaguugcucauaccggccagcacgaccucgugauuccucccaauggguauuuuagauucgauucuugggucaaccaauucuacacgcuggccccuaugggcaacggaaccggccgccggagauga

SEQ ID NO: 29668 - RNA, 1617 nt, Artificial Sequence
  derived and/or modified sequence opt5 from VP1__Norovirus_and/or_Norovirus-like__AB933723
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacagcuacgccgggggauucgaaguccaggugauccuugcuggcaaugccuuuacagcgggcaaaauuaucuucgccgcuguuccucccaacuuuccuacggaggggcugucccccucucaggugaccauguucccgcauaucauugucgacgugagacaacucgagccugugcugaucccccugccugauguccggaauaacuuuuaucacuacaaucagagcaacgacuccacaauuaagcucaucgccaugcuguauacaccccuucgcgcuaacaaugccggagaagauguuuucaccgugagcugcagagugcugacccggcccucuccugacuuugauuucauuuuucucgucccgcccacaguggagucccgcaccaaaccuuucacgguucccauccugaccguggaagagaugacaaacagcagauuuccuauuccccuugagaagcuguucaccggcccgucuuccgccuucgucgugcagccucagaaugggcgguguacaaccgacggaguucuccugggcacgacacaacugagccccgugaacaucugcaccuuucgcggggaugucacacauaucgcuucuuccagaaauuacaccaugaaccucgcgagccugaauuggaacaauuaugacccuaccgaagagauucccgccccucuuggaacacccgauuucgugggcaaaauccagggcaugcugacgcagaccacaaagggggacggauccacccggggccacaaggcuacagucuacaccgggucugccccguuuacgccuaaacucggaagcgugcaguucuccacagacaccgaaaacgauuuugagacccaucaaaauacaaaguucacccccguuggcgugauucaggacgggagcacaacgcaccgcaacgaaccccagcaauggguccugccuucuuacuccggaagaaaugugccgaacguucaccuugcccccgcuguggccccugcguuucccggcgagcagcuccuguucuuucggagcaccaugccuggcuguucuggguaucccaauauggaucuggacugccugcucccucaggaguggguccagcauuucuaccaagaagcugcccccgcccagagcgauguggcucugcuucgcuuugugaacccggacacaggaagaguucuguucgaguguaaacuccacaaguccggcuaugucaccguggcccauacagggcagcacgaucuggugaucccucccaacggauacuuucgguucgacucuugggucaaucaguucuauacccuugcuccuaugggcaacgggacgggcagacgccgguga

SEQ ID NO: 29669 - RNA, 1617 nt, Artificial Sequence
  derived and/or modified sequence opt5 from VP1__Norovirus_and/or_Norovirus-like__AB933708
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaaugcugacgcagaccacaaagggcgacgggagcacccggggacacaaggcuacagucuacaccggcuccgccccguuuacgccuaaacucgggucugugcaguucagcacagacaccgaaaaugauuuugagacccaucaaaacacaaaguucacccccguuggagugauucaggacggcuccacaacgcaccgcaaugaaccccagcaauggguccugccuagcuacucuggcagaaacgugccgaauguucaccuugcccccgcuguggccccuaccuuucccggggagcagcuccuguucuuucgguccacaaugccuggauguagcggcuaucccaacauggaucuggacugccugcucccucaggaguggguccagcauuucuaccaagaagcggcucccgcccagucugauguggcccugcuucgcuuugugaauccggacaccgggagaguucuguucgaguguaaacuccacaagagcggauaugucacaguggcucauaccggccagcacgaucuggugaucccucccaacggguacuuucgguucgacuccugggucaaccaguucuauacgcuugccccuaugggcaauggaaccggcagacgccgguga

SEQ ID NO: 29670 - RNA, 1617 nt, Artificial Sequence
  derived and/or modified sequence opt5 from VP1__Norovirus_and/or_Norovirus-like__LC066046
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauacaaccggcucucacaacuacaccaugaaucucgcuucccagaacuggagcaauuaugaucccacagaggaaaucccugcgccccugggcacgccggacuucguugggaaaauucagggagugcuuacccagacaaccagaacagacggcuccacccgggggcauaaggccacggucuacacaggaucugcugauuuugccccuaagcugggccgcgugcaauucgagaccgacaccaaccacgauuuugaagccaaucagaacacaaaauucacccccguuggggugauccaggacggaggcacaacgcacagaaaugagccccaacaguggguccucccuagcuacuccggccggaacaccccgaaugugcaucuggcucccgccguggcgccuacauuucccggggaacagcuucuguucuuucgcagcaccaugccuggauguucuggcuaucccaacauggaucucgacugccugcugccucaggaguggguucaauacuucuaucaggaggcugcccccgcccaguccgaugucgcucuccugagauuugugaauccggacacagggcgggugcuuuucgaauguaagcugcacaaaagcggauacgucaccguggcccauacgggccagcacgaucucguuaucccucccaacggguauuuuagauucgacucuugggugaaccaauucuacacccuggcuccuaugggcaauggaacaggccgccggagauga

SEQ ID NO: 29671 - RNA, 1617 nt, Artificial Sequence
  derived and/or modified sequence opt5 from VP1__Norovirus_and/or_Norovirus-like__KJ678140
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauguggugaucgacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucaugacuuugaaaccaaucagaacacaaaauucacccccguuggggugauccaggauggaggcacaacgcaccggaaugagccccaacaguggguccucccuuccuacagcggccgcaacaccccgaaugugcaccuggcccccgcuguggccccuacauuucccggggaacagcuucuguucuuuagaucuaccaugccuggauguuccggcuaucccaacauggaccucgauugccugcugccucaggaguggguucaauacuucuaucaggaggcggcucccgcccagagcgacgucgcccuccugcgguuugugaauccggauacagggagagugcuuuucgaauguaagcugcauaaaucuggauacgucaccguggcucacacgggccagcaugaccucguuauuccucccaacggguauuuucgcuucgauagcugggugaaucaauucuacacccuggccccuaugggcaacggaacaggccggagacgcuga

SEQ ID NO: 29672 - RNA, 1617 nt, Artificial Sequence
  derived and/or modified sequence opt5 from VP1__Norovirus_and/or_Norovirus-like__KJ678139
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucaugacuuugaagccaaucagaacaccaaauucacacccguuggggugauccaggauggauccaccacacaccggaaugagccccaacaguggguccucccuagcuacucuggccgcaacacgccgaaugugcaccuggcucccgccguggcgccuaccuuucccggcgaacagcuucuguucuuuagauccacaaugccuggguguagcggauaucccaacauggaccucgauugccugcugccucaggaguggguucaauacuucuaucaggaggcugcccccgcccagucugacgucgcucuccugcgguuugugaauccggauaccggcagagugcuuuucgaauguaagcugcauaaaagcggguacgucacaguggcccacaccggacagcaugaccucguuauuccucccaacggcuauuuucgcuucgauuccugggugaaucaauucuacacgcuggcuccuauggggaacggcaccggacggagacgcuga

SEQ ID NO: 29673 - RNA, 1617 nt, Artificial Sequence
  derived and/or modified sequence opt5 from VP1__Norovirus_and/or_Norovirus-like__EU921383
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugaggcccaucaaaacaccaaguucacacccgugggcgucauucaggacggcgggaccacacaccgcaaugaaccccagcaaugggugcugccuagcuacuccggaagaaacguucacaaugugcaucuugcuccggccgucgcgcccacguuuccuggcgagcagcuccuguucuuucggagcaccaugcccggguguucuggauauccuaacauggaucuggacugccugcucccccaggagugggugcagcacuucuaccaagaagcugccccugcccaguccgauguggcucugcuucgcuuuguuaaucccgacacaggcagaguccuguucgaguguaaacuccauaagagcggguaugugaccguggcccacacaggccagcacgaucuggucaucccgccuaacggauacuuucgguucgacucuugggugaaccaguucuauacccuugcucccaugggcaaugggacgggaagacgccgguga

SEQ ID NO: 29674 - RNA, 1617 nt, Artificial Sequence
  derived and/or modified sequence opt5 from VP1__Norovirus_and/or_Norovirus-like__KP176405
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaacugaaccccuaccucagccaccuggcucgcauguauaauggguacgccggaggcuucgagguccaggugauccuugcuggcaacgccuuuacagcggggaaaguuauuuucgccgcugugccucccaauuuuccuacggagggacugucccccucucaggucaccauguucccgcauaucgugguggaugucagacaacucgaaccuguucugaucccccugccugacgugcggaacaauuuuuaucacuacaaccagagcaaugaucccacaauuaagcucaucgccaugcuguauacaccccuucgcgcuaacaacgccggcgacgauguguucaccgucuccugcagagugcugacccggccuagcccggacuuugauuucauuuuucucguucccccuacaguggagucucgcaccaaacccuucuccgucccugugcugacgguugaagagaugaccaauagcagauuucccaucccgcuugagaagcuguucacagggccuucuuccgccuucgugguccagccccagaacggacgguguaccacagacggcgugcuccuggggaccacgcaacugagcccugucaauauuugcacauuucgcggagaugugacccauaucacaggcucuagaaacuacaccaugaaucucgcuucccagaacuggagcaauuaugaccccaccgaagagauuccugcgccccugggcacaccggauuucguugggaaaauccagggagugcuuacgcagaccacacggaccgacggcuccacacgcgggcacaaggccaccgucuacacgggaucugcugacuuugccccuaagcugggcagagugcaauucgaaacagauaccgaccgggauuuugaggccaaccagaauaccaaauucacacccguuggggugauccaggacggaagcaccacacaucgcaacgaaccccaacaguggguccucccuuccuacagcggcagaaauacgccgaacgugcaccuggcucccgccguggcgccuaccuuucccggcgagcagcuucuguucuuucggucuacaaugccuggguguuccggauaucccaauauggaucucgacugccugcugccucaggaguggguucaauacuucuaucaggaagcugcccccgcccagagcgaugucgcucuccugagauuugugaacccggacaccggccgcgugcuuuucgaguguaagcugcacaaaucuggguacgucacaguggcccauaccggacagcacgaucucguuauuccucccaauggcuauuuucgguucgacagcugggugaaccaauucuacacgcuggcuccuauggggaacggcaccggaagacgccgguga

SEQ ID NO: 29675 - RNA, 1617 nt, Artificial Sequence
  derived and/or modified sequence opt5 from VP1__Norovirus_and/or_Norovirus-like__KP176403
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacacccgguucacacccguuggggugauccaggauggaggcaccacacaccgcaaugagccccaacaguggguccucccuucuuacagcggcagaaacacgccgaaugugcaccuggcucccgccguggcgccuaccuuucccggggaacagcuucuguucuuucgguccacaaugccuggauguagcggcuaucccaacauggaccucgauugccugcugccucaggaguggguucaacauuucuaccaggaggcugcccccgcccagucugacgucgcucuccugagauuugugaauccggauaccgggcgcgugcuuuucgaauguaaacugcacaaguccggauaugucacaguggcccauaccggccagcacgaccucguuauuccucccaacggguacuuucgguucgauagcugggugaaccaauucuauacgcuggcuccuaugggcaauggaaccggcagacgccgguga

SEQ ID NO: 29676 - RNA, 1617 nt, Artificial Sequence
  derived and/or modified sequence opt5 from VP1__Norovirus_and/or_Norovirus-like__KP096343
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccgugccgcuugagaagcuguucacagggccuucuuccgccuucgucgugcagccccagaacggacgguguaccacagauggcguccuccuggggaccacgcaacugagcccugugaauaucugcacauuucgcggagacguuacccauauuacaggcucucacaacuacaccaugaaucucgcuucccagaacuggagcaauuaugaucccaccgaggaaaucccugcgccccugggcacaccggacuucguggggaaaauucagggaguccuuacgcagaccacaagaaccgacggcuccacacgggggcauaaggccaccguguacacgggaucugcugauuuugccccuaagcugggccgcguucaauucgagacagacaccgauagagacuuugaagccaaccagaauaccaaauucacacccgugggggucauccaggauggaggcaccacacaccggaacgagccccaacagugggugcucccuagcuacuccggccgcaauacgccgaacgugcaccuggcucccgccguugcgccuaccuuucccggggaacagcuucuguucuuuagaagcacaaugccuggauguucuggcuaucccaauauggaccucgauugccugcugccucaggaguggguccaauacuucuaucaggaggcugcccccgcccaguccgacguggcucuccugcgguuugugaacccggauaccgggagaguccuuuucgaauguaagcugcauaaaagcggauacgugacaguugcccacaccggccagcaugaccucgugaucccucccaauggguauuuucgcuucgauucuugggucaaccaauucuacacgcuggcuccuaugggcaacggaaccggccggagacgcuga

SEQ ID NO: 29677 - RNA, 1617 nt, Artificial Sequence
  derived and/or modified sequence opt5 from VP1__Norovirus_and/or_Norovirus-like__KM268101
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuugccccuaagcugggccgcauccaauucgagacagacaccaaucacgauuuugaagccaaccagaauaccaaauucacacccguggggguuauucaggacggaggcaccacacacagaaacgagccccaacagugggugcucccuucuuacagcggccggaauacgccgaacguccaucuggcucccgccguggcgccuaccuuucccggggaacagcuucuguucuuucgcuccacaaugccuggauguagcggcuaucccaauauggaucucgacugccugcugccucaggagugggugcaauacuucuaucaggaggcugcccccgcccagucugauguugcucuccugagauuugucaacccggacaccgggcgggugcuuuucgaauguaagcugcacaaauccggauacgugacagucgcccauaccggccagcacgaucucgugaucccucccaacggguauuuuagauucgacagcuggguuaaucaauucuacacgcuggcuccuaugggcaacggaaccggccgccggagauga

SEQ ID NO: 29678 - RNA, 1617 nt, Artificial Sequence
  derived and/or modified sequence opt5 from VP1__Norovirus_and/or_Norovirus-like__KM198568
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucaucguccagccucagaauggccgguguacaaccgacggggugcuccugggaacgacacaacugucucccguuaacaucugcaccuuucgcggcggcgugacacauauugcuggguccagaaauuacaccaugaaccucgcgagccugaauuggaacaauuaugauccuaccgaagagauccccgccccucuuggaacacccgacuucgucggcaaaauucagggggugcugacgcagaccacaaagggagauggcucuacccgggggcacaaggcuacagucuacaccggauccgccccguuuacgccuaaacucggcagcgugcaguucuccacagacaccgaaaacgacuuugaggcccaucaaaauaccaaguucacacccguuggcgugauccaggaugggggaaccacacaccgcaacgaaccccagcaauggguccugccuucuuacagcggcagagacgugcacaauguucaucuugcuccggccguggcgcccacguuuccuggggagcagcuccuguucuuucgguccaccaugcccggauguagcggcuauccuaacauggaucuggacugccugcucccccaggaguggguccagcacuucuaccaagaagcugccccugcccagucugauguggcucugcuucgcuuugugaaucccgacacagggagaguucuguucgaguguaaacuccauaaguccggcuaugucaccguggcccacacaggacagcacgaucuggugauuccgccuaacggcuacuuucgguucgacagcugggucaaccaguucuauacccuugcucccauggggaauggaacgggcagacgccgguga

SEQ ID NO: 29679 - RNA, 1617 nt, Artificial Sequence
  derived and/or modified sequence opt5 from VP1__Norovirus_and/or_Norovirus-like__KM198532
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccugucccccuugagaagcuguucacagggccgagcggagccuucgugguucagccucagaacggccgguguaccacggacggggugcuccugggaacaacccaacugucucccgucaauauuugcacauuucgcggcgaugugacccauaucgcuggcuccagaaacuacaccaugaaucucgcgagccugaacuggaauaacuaugacccuacagaagagauccccgccccucuugggacgcccgauuucgucggaaaaauucagggcgugcugacccagacaaccaagggggacggaucuacacggggccacaaggcuaccguuuacacgggguccgccccguuuacaccuaaacucggaagcgugcaguucuccaccgacaccgaaaaugauuuugagacacaucaaaacaccaaguucacacccgucggcgugauccaggacggcgggacgacccaccgcaaugaaccccagcaauggguucugccuucuuacagcggaagagaugugcacaacguccaucuugccccggcuguggcccccacauuuccuggcgagcagcuccuguucuuucgguccaccaugcccggguguagcggauauccuaauauggaccuggauugccugcucccccaggagugggugcagcacuucuaccaagaagcggcuccugcccagucugacguugcccugcuucgcuuugucaaccccgauacaggcagagugcuguucgaguguaaacuccauaaguccggguaugugaccgucgcucacacgggccagcacgaccuggugauuccgccuaauggauacuuucgguucgauagcuggguuaaccaguucuauacccuugcccccaugggcaacgggacaggaagacgccgguga

SEQ ID NO: 29680 - RNA, 1617 nt, Artificial Sequence
  derived and/or modified sequence opt5 from VP1__Norovirus_and/or_Norovirus-like__KM198527
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcucuacgacccaccgcaaugaaccccagcaaugggugcugccuagcuacuccgggagagauguucacaacgugcaucuugccccggcugucgcccccacauuuccuggagagcagcuccuguucuuucggagcaccaugcccggcuguucuggguauccuaauauggaccuggauugccugcucccccaggagugggugcagcacuucuaccaagaagcggcuccugcccaguccgacguggcccugcuucgcuuuguuaaccccgauacaggaagaguccuguucgaguguaaacuccauaagagcggcuaugugaccguggcucacacggggcagcacgaccuggucaucccgccuaauggcuacuuucgguucgauucuugggugaaccaguucuauacccuugcccccaugggaaacggcacagggagacgccgguga

SEQ ID NO: 29681 - RNA, 1617 nt, Artificial Sequence
  derived and/or modified sequence opt5 from VP1__Norovirus_and/or_Norovirus-like__KF177448
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcuccgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauuggaacaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccacacaccggaacgagccccaacaguggguccucccuuccuacagcggccgcaauacgcacaacgugcaucuggcuccggccguggcgcccaccuuuccuggcgaacagcuucuguucuuuagaucuacaaugcccggguguuccggauauccuaauauggaccucgauugccugcugccccaggaguggguucaauacuucuaucaggaggcugccccugcccagagcgacgucgcucuccugcgguuugugaaccccgauaccggcagagugcuuuucgaauguaagcugcacaaaucuggguacgucacaguggcccauaccggacagcacgaccucguuauuccgccuaauggcuauuuucgcuucgauagcugggugaaccaauucuacacgcuggcucccauggggaacggcaccggacggagacgcuga

SEQ ID NO: 29682 - RNA, 1617 nt, Artificial Sequence
  derived and/or modified sequence opt5 from VP1__Norovirus_and/or_Norovirus-like__KF008244
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaaaccaaucagaacacaaaauucacccccguuggggugauccaggauggaucuacaacgcaccggaaugagccccaacaguggguccucccuagcuacuccggccgcaacacccacaaugugcaucuggccccggcuguggcccccacauuuccuggcgaacagcuucuguucuuuagaagcaccaugcccggguguucuggauauccuaacauggaccucgauugccugcugccccaggaguggguucaauacuucuaucaggaggcggcuccugcccaguccgacgucgcccuccugcgguuugugaaucccgauacaggcagagugcuuuucgaauguaagcugcacaaaagcggguacgucaccguggcucauacgggacagcacgaccucguuauuccgccuaacggcuauuuucgcuucgauucuugggugaaccaauucuacacccuggcccccauggggaauggcacaggacggagacgcuga

SEQ ID NO: 29683 - RNA, 1617 nt, Artificial Sequence
  derived and/or modified sequence opt5 from VP1__Norovirus_and/or_Norovirus-like__KF060103
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcucccacaacuacaccaugaaucucgccagccagaacuggaacuccuaugaucccaccgaggaaaucccugcuccccugggcacaccggacuucgucgggaaaauucagggagugcuuacgcagaccacaagaaccgacggcucuacacgggggcauaaggcgaccguuuacacgggaagcgccgauuuuuccccuaagcugggccgcgugcaauucgcuacagacaccgauaaugacuuugagaccaaucagaacacaaaauucacccccgucggggugauccaggauggaggcacaacgcacagaaaugaaccccaacaguggguucucccuagcuacucuggccggaacauucacaaugugcaucuggccccggccgucgcucccaccuuuccuggggagcagcuucuguucuuucgcuccacaaugcccggauguagcggcuauccuaacauggaccucgauugccugcugccccaggaaugggugcaauacuucuaucaggaggccgcgccugcucagucugacguggcccuccugagauuuguuaaucccgauaccgggcggguccuuuucgaguguaagcugcacaaaagcggauacgugacaguggcccauaccggccagcacgaccucgucaucccgccuaacggguauuuuagauucgauuccugggugaaccaauucuacacgcuggcucccaugggcaauggaaccggccgccggagauga

SEQ ID NO: 29684 - RNA, 1617 nt, Artificial Sequence
  derived and/or modified sequence opt5 from VP1__Norovirus_and/or_Norovirus-like__KC960615
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucagagugauccuugcuggcaacgccuuuacagcggggaaaauuaucuucgccgcuguuccucccaauuuuccuacggagggacugucccccucucaggugaccauguucccgcauaucauugucgacgugcggcagcucgagccugugcugaucccccugccugauguccgcaacaauuuuuaucacuacaaccaaacaaaugacagcaccauuaagcucaucgccaugcuguauacaccccuuagagcuaacaacgccggcgaagauguuuucaccguguccugccgggugcugacacgccccagcccugacuuugauuucauuuuucucgucccgcccaccguggagucuagaacgaaaccuuucaccguucccauccugacaguggaagagaugaccaauucccgguuuccuauuccccuugagaagcuguucacagggccgagcucugccuucgucgugcagccucagaacggacgcuguaccacggacggcguucuccuggggacaacccagcugucccccgugaauaucugcacauuuagaggagaugucacccauaucgcuggcagccggaacuacaccaugaaucucgcgucucugaacuggaauaacuaugacccuacagaagagauucccgccccucuuggcacgcccgauuucguggggaaaauccaaggaguccugacccagacaaccaagggcgacggguccacacgcggacacaaggcuaccguguacacgggcagcgccccguuuacaccuaaacucggguccguucaguucucuaccgacaccgaaaaugauuuugagauucaucagaacacaaaguucacccccgugggagucauccaagacggcggcacaacgcacagaaaugaaccccagcagugggugcugccuagcuacuccgggcgggauguucacaacgugcaucuugccccggcugucgcccccaccuuuccuggagagcaacuccuguucuuucgcagcacaaugcccggcuguucuggguauccuaauauggaccuggauugccugcucccccaggagugggugcagcacuucuaccaggaagcggcuccugcccaauccgacguggcccugcuuagauuuguuaaccccgauaccggacggguccuguucgaguguaaacuccauaagagcggcuaugugacaguggcucacaccgggcagcacgaccuggucauuccgccuaauggcuacuuuagauucgauucuugggugaaccaguucuauacgcuugcccccaugggaaacggcaccgggcgccggagauga

SEQ ID NO: 29685 - RNA, 1617 nt, Artificial Sequence
  derived and/or modified sequence opt5 from VP1__Norovirus_and/or_Norovirus-like__KC517373
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccggguuuccuauuccccuugagaagcuguucaccggaccgagcucugccuucgucgugcagccucagaauggcagauguacaaccgacgggguucuccugggaacgacacaacugucccccgugaacaucugcaccuuucggggcgaugucacacauaucgcuggcagccgcaauuacaccaugaaccucgcgucucugaauuggaacaauuaugacccuaccgaagagauucccgccccucuugggacacccgauuucgugggaaaaguccagggcgugcugacgcagaccacaaagggggacggauccaccagaggccacaaggcuacaguuuacaccgggagcgccccguuuacgccuaaacucggauccgugcaguucgaaacagacaccgagaacgauuuugaaacccaucaaaauacaaaguucacccccgucggcgugauccaggacggcgggacagcccaccggaacgagccccagcaauggguucugccuucuuacagcggacgcaaugugccgaacguccaccuugcucccgccguggcgccuacguuucccggcgagcagcuccuguucuuuagauccaccaugccuggguguagcggauaucccaauauggaucuggacugccugcucccucaggaaugggugcagcauuucuaccaagaggcugcccccgcccagucugauguugcucugcuucgguuugucaacccggacacaggccgcgugcuguucgaauguaaacuccacaaguccggguaugugaccgucgcccauacaggccagagagaucuggugauuccucccaacggauacuuucgguucgacagcuggguuaaucaguucuauacccuugcuccuaugggcaacgggacgggaagacgccgguga

SEQ ID NO: 29686 - RNA, 1617 nt, Artificial Sequence
  derived and/or modified sequence opt5 from VP1__Norovirus_and/or_Norovirus-like__JX459615
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugaguuugacuucauuuuucucgucccgcccacaguggaaucucgcaccaaaccuuucacgguucccauccugaccguggaggagaugacaaacuccagauuuccuauuccccuugaaaagcuguucaccgggccgagcggagccuucgucgugcagccucagaauggccgguguacaaccgaugggguucuccugggaacgacacaacugucucccgugaacaucugcaccuuucgcggcgacgucacacauaucgcuggcuccagaaauuacaccaugaaccucgcgagccugaauuggaacaauuaugauccuaccgaggaaauucccgccccucuugggacacccgacuucgugggaaaaauccagggcguccugacgcagaccacaaagggggauggaucuacccggggccacaaggcuacaguguacaccggguccgccccguuuacgccuaaacucggaagcguucaguucuccacagacaccgagaacgacuuugaaacccaucaaaauacaaaguucacccccgugggcgucauucaggauggcgggacaacgcaccgcaacgagccccagcaaugggugcugccuucuuacagcggaagaaauguucacaacgugcaucuugccccggcugucgcccccaccuuuccuggcgagcagcuccuguucuuucgguccacaaugcccggguguagcggauauccuaauauggaccuggauugccugcucccccaggaaugggugcagcacuucuaccaagaggcggcuccugcccagucugacguggcccugcuucgcuuuguuaaccccgauaccggcagaguccuguucgaauguaaacuccauaaguccggguaugugacaguggcucacaccggccagcacgaccuggucaucccgccuaacggauacuuucgguucgauagcugggugaaucaguucuauacgcuugcccccaugggcaacgggaccggaagacgccgguga

SEQ ID NO: 29687 - RNA, 1617 nt, Artificial Sequence
  derived and/or modified sequence opt5 from VP1__Norovirus_and/or_Norovirus-like__JX459603
augaagauggccagcaacgacgcuacccccuccgauggcguggccgcgcaccuggucccugagguuaauaacgaagugauggcucucgagccgguggucggggccgccaucgcugcccccguggcuggacagcaaaauguuauugacccuuggaucagaaacaauuucgugcaggcccccggcggggaauuuacagucucuccucggaacgcgcccggagagauucuguggagcgccccucuuggcccggaucugaaucccuaccucucccaucuggcucgcauguauaacggguacgccggaggcuucgaagugcagguuauccuugcuggcaaugccuuuacggcggggaaaauuaucuucgccgcugugccucccaacuuuccuaccgagggacugucucccagccaggucacaauguucccgcacaucauuguggacgugagacaacucgagccuguccugaucccccugccugauguucggaauaacuuuuaucauuacaaucaguccaacgacucuaccauuaagcucaucgccaugcuguauacaccccuucgcgcuaauaacgccggcgaagauguguucaccgugagcugcagaguccugacacggcccuccccugacuuugauuucauuuuucucgugccgcccaccguugagagccgcacgaaaccuuucaccgugcccauccugacagucgaagagaugaccaacucuagauuuccuauuccccuugagaagcuguucacagggccguccggagccuucgugguucagccucagaauggccgguguaccacggacggggugcuccugggaacaacccaacugagccccgucaacaucugcacauuucgcggcgaugugacccacaucgcuggcucuagaaauuacaccaugaaccucgcgucccugaauuggaacaauuaugacccuacagaagagauucccgccccucuugggacgcccgauuucgucggaaaaauccagggcgugcugacccagacaaccaagggggacggaagcacacggggccauaaggcuaccguuuacacggggucugccccguuuacaccuaaacucggauccgugcaguucagcaccgacaccgaaaacgauuuugagacacaccaaaauaccaaguucacacccgucggcgugauucaggacggcgggacgacccaccgcaacgaaccccagcaauggguucugccuuccuacucuggaagaaaugugcauaacguccaccuugccccggcuguggcccccacauuuccuggcgagcagcuccuguucuuucggagcaccaugcccggguguuccggauauccuaauauggaucuggacugccugcucccccaggagugggugcagcauuucuaccaagaagcggcuccugcccagagcgauguugcccugcuucgcuuugucaaccccgacacaggcagagugcuguucgaguguaaacuccacaagucuggguaugugaccgucgcucacacgggccagcaugaucuggugaucccgccuaauggauacuuucgguucgacuccuggguuaaccaguucuauacccuugcccccaugggcaacgggacaggaagacgccgguga

SEQ ID NO: 29688 - RNA, 1617 nt, Artificial Sequence
  derived and/or modified sequence opt5 from VP1__Norovirus_and/or_Norovirus-like__JX155746
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagaaaugugccgaacguucaccuugcccccgcuguggccccuaccuuucccggggagcagcuccuguucuuucggucuacaaugccuggauguuccggcuaucccaauauggaucuggacugccugcucccucaggaguggguccagcauuucuaccaagaagcggcucccgcccagagcgauguggcccugcuucgcuuugugaacccggacaccgggagaguucuguucgaguguaaacuccacaagccuggauaugucacaguggcucauaccggccagcacgaucuggugauucccccuaacggguacuuucgguucgacucuugggucaaucaguucuauacgcuugcccccaugggcaacggaaccggcagacgccgguga

SEQ ID NO: 29689 - RNA, 1617 nt, Artificial Sequence
  derived and/or modified sequence opt5 from VP1__Norovirus_and/or_Norovirus-like__AB541333
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuugauccggaccugaaucccuaccucucucagcuggcucgcauguauaacggcuacgccgggggauucgaaguccaggugauccuugcuggcaaugccuuuacagcgggcaaaauuaucuucgccgcuguuccucccaacuuuccuacggaggggcugagccccucccaagugaccauguucccgcacaucauugucgaugugagacagcucgagccugugcugaucccccugccugacguccggaauaacuuuuaucauuacaaucagucuaacgauagcacaauuaagcucaucgccaugcuguauacaccccuucgcgcuaacaaugccggagaagacguuuucaccguguccugcagagugcugacccggcccagcccugauuuugacuucauuuuucucgucccgcccacaguggagucucgcaccaaaccuuucacgguucccauccugaccguggaagagaugacaaacuccagauuuccuauuccccuugagaagcuguucaccggcccgagcucugccuucgucgugcagccucaaaaugggcgguguacaaccgauggaguucuccugggcacgacacagcugucccccgugaacaucugcaccuuucgcggggacgucacacacaucgcuggaagcagaaauuacaccaugaaccucgcgucucugaauuggaacaauuaugauccuaccgaagagauucccgccccucuuggcacacccgacuucgugggcaaaauccaggggguccugacgcagaccacaaagggagacggcuccacccgggggcauaaggcuacaguguacaccggaagcgccccguuuacgccuaaacucggcuccguucaauucucuacagauaccgaaaacgacuuugagacccaccagaauacaaaguucacccccgugggggucauucaggauggaggcacaacgcaucgcaacgaaccccaacagugggugcugccuagcuacuccggcagaaauguuccgaacgugcaccuugcccccgcugucgccccuaccuuucccggggagcagcuccuguucuuucggagcacaaugccuggauguucuggcuaucccaauauggaccuggauugccugcucccucaggagugggugcaacacuucuaccaggaagcggcucccgcccaguccgacguggcccugcuucgcuuuguuaacccggauaccgggagaguccuguucgaguguaaacuccauaagagcggauaugugacaguggcucacaccggccagcaugaccuggucaucccucccaacggguacuuucgguucgauucuugggugaaucaauucuauacgcuugccccuaugggcaacggaaccggcagacgccgguga

SEQ ID NO: 29690 - RNA, 1617 nt, Artificial Sequence
  derived and/or modified sequence opt5 from VP1__Norovirus_and/or_Norovirus-like__AB541220
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacucuauaagagcggcuacgugacaguggcucacaccgggcagcaugaucuggucaucccucccaacggcuauuuucgguucgacucuugggugaaucaguucuacacgcuugccccuaugggaaacggcaccgggagacgccgguga

SEQ ID NO: 29691 - RNA, 1617 nt, Artificial Sequence
  derived and/or modified sequence opt5 from VP1__Norovirus_and/or_Norovirus-like__AB504312
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugacagcacaauuaagcucaucgcuaugcuguauacaccccuucgcgccaacaacgcuggcgaugacguuuucaccguguccugcagagugcugacccggcccagcccugauuuugacuucauuuuucucgucccgcccacgguggaaucucgcaccaaaccuuucuccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucgccggcacccagaacuacacaaugaaucucgcuucucagaacuggaauaacuaugauccuacggaggaaauucccgcgccucugggcacccccgacuucguggggaaaauccagggaguccuuacacaaaccacaagacgggacggcuccacccgcgggcacaaggccacggugagcacaggauccguucauuuuaccccgaagcugggcucugugcaguucagcaccgauacauccaaugacuuugagaccgggcagaacacaagauucacgccugucggagugguucaagauggcagcaccacacaccagaaugaaccccagcagugggugcuccccaacuacucuggccgggacucccacaauguccaucuggcuccugccguggccccgaccuuucccggggagcaacuucuguucuuucgcagcacaaugccuggauguucuggcuaccccaacaugaaucucgauugccugcugccucaggaaugggugcagcacuucuaucaggagagcgcucccgcccaauccgacguugcgcuccugagauuugucaacccugauaccgggcgggugcuuuucgagugugaacugcauaaaucuggauacgugacggucgcucacaccggccagcacgaccucgugauucccccgaacggguauuuuagauucgauagcuggguuaaucaguucuacacacuggccccuaugggcaacggagccggccgccggagauga

SEQ ID NO: 29692 - RNA, 1617 nt, Artificial Sequence
  derived and/or modified sequence opt5 from VP1__Norovirus_and/or_Norovirus-like__GQ849126
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucgucguggacgugagacaacucgagccuguccugauuccccugccugauguucggaacaauuuuuaucacuacaaccaguccaaugaccccaccaucaagcucauugcuaugcuguauacaccccuucgcgccaacaacgcuggagaugacguguucaccgugagcugcagaguccugacacggccuucuccggauuuugacuucaucuuucucgugcccccuaccguugaaucccgcacgaaacccuucagcgugccuauucugaccgucgaggaaaugacaaauucuagauuucccaucccgcuugagaagcuguucaccggcccuuccagcgccuucgugguucagccccagaacgggcgguguacaaccgauggagugcuccugggcacgacacaacugucuccugucaauauuugcaccuuucgcgggaacgugacacauaucgccggaacccaggaguacaccaugaaucucgcuucccagaacuggaauaacuaugaccccacagaagagaucccugcgccccugggcacgccggauuucgucggcaaaauucagggggugcuuacccaaacaaccagacgggacggaagcacacgcggccacaaggccaccguuuccacggggucugugcauuuuacaccuaagcugggaagaauccaguucagcaccgacaccuccaaugauuuugaaacaggccagaacacccgguucacacccgucggggugguucaagacggaagcacgacccaccagaaugagccccagcagugggugcucccuaacuacucuggccgcgauucccacaauguccaucuggcuccggccguggcccccagcuuuccuggcgaacaacuucuguucuuuagaucuacaaugcccggguguagcggauacccuaacaugaaucucgacugccugcugccccaggagugggugcagcacuucuaucaggaggcugccccugcgcaauccgauguugcucuccugcgguuugucaaccccgacaccggcagagugcuuuucgaauguaaacugcauaagucuggguacgugacagucgcccacaccggacagcacgaucucgugauuccgccuaacggcuauuuucgcuucgacagcuggguuaaucaguucuacacgcuggcccccauggggaacggcaccggacggagacgcuga

SEQ ID NO: 29693 - RNA, 1617 nt, Artificial Sequence
  derived and/or modified sequence opt5 from VP1__Norovirus_and/or_Norovirus-like__AB447459
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggccugcucacgcagaccacaaagggggacggaucuacccggggccacaaggcuacagucuacaccggguccgccccguuuacgccuaaacugggaagcgugcaguucuccacagacaccgaaaacgauuuugagacccaucaaaauacaaaguucacccccguuggcgugauucaggacggcucuacaacgcaccgcaacgaaccccagcaauggguccuuccuagcuacuccgggagaaaugugcacaacguucaucuggccccggcuguggcccccaccuuuccuggagagcagcucaucuucuuucggagcacaaugcccggcuguucuggguauccuaauauggaucuggacugccugcucccccaggaguggguccagcacuucuaccaagaagcggcuccugcccaguccgauguggcccugcuucgcuuugugaaccccgacaccggaagaguucuguucgaguguaaacuccauaagagcggcuaugucacaguggcucacaccgggcagcacgaucuggugauuccgccuaacggcuacuuucgguucgacucuugggucaaucaguucuauacgcuugcccccaugggaaacggcaccgggagacgccgguga

SEQ ID NO: 29694 - RNA, 1617 nt, Artificial Sequence
  derived and/or modified sequence opt5 from VP1__Norovirus_and/or_Norovirus-like__EU078413
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaaugaccaacuccagauuuccuauuccccuugagaagcuguucacagggccgagcggagccuucgucgugcagccucagaauggccgguguaccacggaugggguucuccugggaacaacccaacugucucccgugaacaucugcacauuucgcggcgacgucacccauaucgccggcaccagaaauuacacaaugaaccucgcuucccagaauuggaacaauuaugauccuacggaggaaauucccgcgccucuggggacccccgacuucgugggacggauccagggcaugcuuacacagaccacacgcagagacgggagcacccggggacacaaagccacggucucuacaggcgaugcucauuuuaccccgaagcugggguccauuauguucagcaccgacacagauaacgacuuugagaccggacaaaauacaaaguucacgccugugggcguugugcaggauggcaacgggacccaccagaaugaaccccaacaguggguccuccccuccuacucuggacgcacaggccacaacgugcaucuggccccugccguugcuccgaccuuucccggggagcagcuucuguucuuuagaagcacaaugccuggauguuccggcuaccccaauaugaaccucgacugccugcugccucaggaaugggugcaacacuucuaucaggaggccgcgcccgcucagagcgaugucgcccuccugcgguuugugaacccugacaccgggagagugcuuuucgaguguaaacugcauaagucuggcuacguuacggucgcccacaccggacagcacgaucucgugauucccccgaauggcuauuuucgcuucgacuccugggugaaccaauucuacacacuggcuccuauggggaauggaaccggccggagacgcuga

SEQ ID NO: 29695 - RNA, 1617 nt, Artificial Sequence
  derived and/or modified sequence opt5 from VP1__Norovirus_and/or_Norovirus-like__EU078411
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucaccguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauauccccggcaccagaacauaccggaugaaccucgccagccagaauuggaacaauuaugauccuacggaggaaauucccgcuccgcugggcaccccugacuucguggggaaaauccagggaaugcuuacacagaccacaaagggcgacgggucuacccgcggacacaaggcgacggucuccacaggcagcguggauuuuacccccaaacugggguccguucaauucgccaccgacacagauaacgacuuugagaccggacagaauacaagauucacgcccgugggcgucauucaggauggcucuagcgcucaucggaacgaaccucaacagugggugcucccggacuacuccgggcgcaccguucacaaugugcaccuggcccccgccgucgcuccuacauuucccggagagcagcuucuguucuuuagaagcaccaugccuggcuguucuggguaccccaacauggaucucgacugccugcugccucaggaaugggugcaacauuucuaucaggaggccgcgcccgcucaguccgauguggcccuccugcgguuuguuaauccggacacaggaagaguccuuuucgaguguaagcugcacaaaaccggcuacgugacgguggcccauaccgggcagcacgaucucgucaucccucccaacggcuauuuucgcuucgacagcugggugaaucaauucuacacacuggcuccuaugggaaacggcgccgggcggagacgcuga

SEQ ID NO: 29696 - RNA, 1617 nt, Artificial Sequence
  derived and/or modified sequence opt5 from VP1__Norovirus_and/or_Norovirus-like__AB385632
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuguuuucgcggccgugccucccaauuuuccuaccgaggggcugucucccagccaggucacaauguucccgcauaucaucguggacgugagacaacucgagccuguccugauuccccugccugauguucggaacaauuuuuaucacuacaaccaguccaaugaccccaccaucaagcucauugcuaugcuguauacaccccuucgcgccaacaacgcuggagaugacguguucaccgugagcugcagaguccugacacggccuucuccggauuuugacuucaucuuucucgugcccccuaccguugaaucccgcacgaaacccuucagcgugccuauucugaccgucgaggaaaugacaaauucuagauuucccaucccgcuugagcggcuguucaccggcccuuccagcgccuucgugguucagccccagaacgggcgcuguacaaccgauggagugcuccugggcacgacacaacugucuccugucaauauuugcaccuuuagaggggacgugacacauaucgccggaacccaggaguacaccaugaaccucgcuucccagaauuggaacaauuaugaucccacagaagaggucccugcgccccugggcacgccggacuucaugggcaagauccagggggugcuuacccaaacaacccggcgcgacggaagcacaagaggccacaaagccaccguuuccacggggucugugcauuuuacaccuaagcugggacggauucaguucagcaccgauaccuccaacgacuuugaaacaggccagaauacccgcuucacacccgucggggugguucaagauggaagcacgacccaccagaacgagccccagcagugggugcucccuaauuacucuggcagagacucccacaacguccaucuggcuccggccguggcccccagcuuuccuggcgaacaacuucuguucuuucggucuacaaugcccggguguagcggauacccuaauaugaaccucgauugccugcugccccaggagugggugcagcacuucuaucaggaggcugccccugcgcaauccgacguugcucuccugagauuugucucucccgauaccggccgcgugcuuuucgaauguaagcugcauaaaagcggguacgugacagucgcccacaccggacagcacgaccucgugaucccgccuaauggcuauuuucgguucgauuccuggguuaaccaguucuacacgcuggcccccauggggaacggcaccggaagacgccgguga

SEQ ID NO: 29697 - RNA, 1617 nt, Artificial Sequence
  derived and/or modified sequence opt5 from VP1__Norovirus_and/or_Norovirus-like__EU839595
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccuggguuugacuucauuuuucucgucccgcccacaguggagucucgcaccaaaccuuucacgguucccauccugaccguggaagagaugacaaacuccagauuuccuauuccccuugagaagcuguucaccggaccgagcucugccuucgucgugcagccucagaauggccgguguacaaccgaugggguucuccugggaacgacacaacugucccccgugaacaucugcaccuuucgcggcgacgucacacauaucgcuggcagcagaaauuacaccaugaaccucgcgucucugaauuggaacaauuaugauccuaccgaagagauucccgccccucuugggacacccgacuucgugggaaaaauccagggcguccugacgcagaccacaaagggggauggauccacccggggccacaaggcuacaguguacaccgggagcgccccguuuacgccuaaacucggauccguucaguucucuacagacaccgaaaacgacuuugagacccaucaaaauacaaaguucacccccgugggcgucauucaggauggcgggacaacgcaccgcaacgaaccccagcaaugggugcugccuagcuacuccggaagaaauguuccgaacgugcaccuugcccccgcugucgccccuaccuuucccggcgagcagcuccuguucuuucggagcacaaugccuggguguucuggauaucccaauauggaccuggauugccugcucccucaggagugggugcagcauuucuaccaagaagcggcucccgcccaguccgacguggcccugcuucgcuuuguuaacccggauaccggcagaguccuguucgaguguaaacuccacaagagcggguaugugacaguggcucauaccggccagcacgaccuggucaucccucccaacggauacuuucgguucgauucuugggugaaucaguucuauacgcuugccccuaugggcaacgggaccggaagacgccgguga

SEQ ID NO: 29698 - RNA, 1617 nt, Artificial Sequence
  derived and/or modified sequence opt5 from VP1__Norovirus_and/or_Norovirus-like__AB294788
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugacagcacaauuaagcucaucgcuaugcuguauacaccccuucgcgccaacaacgcuggcgaugacguuuucaccguguccugcagagugcugacccggcccagcccugauuuugacuucauuuuucucgucccgcccacgguggaaucucgcaccaaaccuuucuccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucgccggcacccagaacuacacaaugaaucucgcuucucagaacuggaauaacuaugauccuacggaggaaauucccgcgccucugggcacccccgacuucguggggaaaauccagggaguccuuacacaaaccacaaccagagacggcuccacgcgggggcacaaggccacagugagcaccggauccguucauuuuaccccgaagcugggcucugugcaguucagcacagauaccuccaaugacuuugagacagggcagaacacgcgcuucaccccugucggagugguucaagauggcagcacaacccaccagaaugaaccccagcagugggugcuccccgacuacucuggcagagauucccacaacguccaucuggcuccugccguggccccgacauuucccggggagcaacuucuguucuuucggagcaccaugccuggauguucuggcuaccccaauaugaaccucgacugccugcugccucaggaaugggugcagcacuucuaucaggagagcgcucccgcccaauccgauguugcgcuccugcgcuuugucaauccugacacggggagagugcuuuucgaguguaaacugcauaagucuggauacgugaccgucgcucacacaggccagcacgaucucgugauucccccgaacggguauuuucgguucgacagcuggguuaaccaguucuacacccuggccccuaugggcaauggagccggcagacgccgguga

SEQ ID NO: 29699 - RNA, 1617 nt, Artificial Sequence
  derived and/or modified sequence opt5 from VP1__Norovirus_and/or_Norovirus-like__AB303936
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccagcuuuccuacagagggacugucccccucucaggugaccauguucccgcauaucauugucgacgugagacaacucgagccugugcugaucccccugccugauguccggaauaacuuuuaucacuacaaucagagcaacgaccccacaauuaagcucaucgcuaugcuguauacaccccuucgcgccaauaacgcuggcgaagauguuuucaccguguccugcagagugcugacccggccuagcccggacuuugauuucauuuuucucgugcccccuacggucgagucucgcaccaaacccuucacaguuccuauccugaccguggaagagaugacaaacuccagauuucccauuccgcuugagaagcuguucaccgggccuagcggagccuucgucgugcagccccagaauggccgguguacgacagacgggguucuccugggaaccacacaacugucuccugugaacaucugcaccuuucgcggcgaugucacccauaucgccggcacacacaauuacacgaugaaccucgcuucccagaauuggaacaauuaugaccccaccgaagagauuccugcgccccuggggacaccggauuucgugggaagaauccagggcaugcuuacccagacaacccgcggggacggaagcacgcggggccauaaagccacagucucuaccggggacgugcacuuuaccccuaagcugggauccguucaauucgauacagacaccaacagcgauuuugaaacaggccagaauacgaaguucacccccgugggcgucgugcaggacgggaacggagcucaccaaaaugagccccagcaguggguucucccuuccuacucuggcagaacagggcauaacgcccaccuggccccggcuguggcccccaccuuuccuggagaacagcuucuguucuuucggagcacaaugcccggcuguuccggguacccuaauaugaaccucgauugccugcugccccaagaguggguccagcauuucuaucaggaggcggcuccugcccagagcgacguggcccuccugcgcuuugugaaucccgauaccggcagaguucuuuucgaauguaaacugcacaagucuggauacgucacgguggcucacaccggccaacaugaccucgugauuccgccuaacggguauuuucgguucgauuccugggucaaccaguucuacacacuggcccccaugggaaauggcaccgggagacgccgguga

SEQ ID NO: 29700 - RNA, 1617 nt, Artificial Sequence
  derived and/or modified sequence opt5 from VP1__Norovirus_and/or_Norovirus-like__AB303935
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccagcuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaagauguuuucaccguguccugcagagugcugacacggccuagcccggacuuugauuucauuuuucucgugcccccuaccgucgagucucgcacgaaacccuucaccguuccuauccugacaguggaagagaugaccaauuccagauuucccauuccgcuugagaagcuguucacagggccuagcggagccuucgucgugcagccccagaacggccgguguaccacggacgggguucuccugggaacaacccaacugucuccugugaauaucugcacauuucgcggcgaugucacccauaucgccggcacccacaacuacacaaugaaucucgcuucccagaacuggaauaacuaugaccccacggaagagauuccugcgccccuggggaccccggauuucgugggaagaauccagggcaugcuuacacagaccacacgcggggacggaagcacccggggccauaaagccacggucucuacaggggacgugcacuuuaccccuaagcugggauccauucaauucaauaccgauacaaacaaugacuuugaaaccggccagaacacaaaguucacgcccguuggcgugguccaggaugggaauggaacccaccaaaacgagccccagcagugggugcucccuagcuacuccggcagaacagggcauaauguucaccuggcuccggccguggcccccaccuuuccuggagaacagcuucuguucuuucggucuacaaugcccggcuguagcggguacccuaacaugaaccucgacugccugcugccccaagaguggguccagcauuucuaucaggaggcugccccugcgcaguccgauguggcucuccugcgcuuugugaaucccgacaccggcagaguucuuuucgaauguaaacugcacaagagcggauacgucacgguggcccacaccggccaacaugaucucgugaucccgccuaacggguauuuucgguucgacucuugggucaaucaguucuacacacuggcccccaugggaaacggcaccgggagacgccgguga

SEQ ID NO: 29701 - RNA, 1617 nt, Artificial Sequence
  derived and/or modified sequence opt5 from VP1__Norovirus_and/or_Norovirus-like__AY588018
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuguucaauucaacaccgauacaaauaacgacuuugaaaccggccagaauacaaaguucacgcccgugggcgucgugcaggaugggaacggagcucaccaaaaugagccccagcaguggguucucccuuccuacagcggcagaaccgggcauaacgugcaccuggccccggccgucgcucccacauuuccuggagaacagcuucuguucuuucgguccaccaugcccggcuguucuggguacccuaacaugaaucucgacugccugcugccccaagagugggugcagcauuucuaucaggaggccgcgccugcucagagcgauguggcccuccugcgcuuuguuaaccccgacacaggcagaguccuuuucgaauguaaacugcacaaguccggauacgugaccguggcccacacgggccaacaugaucucgucauuccgccuaauggguauuuucgguucgacagcugggugaaccaguucuacacccuggcucccaugggaaauggcacagggagacgccgguga

SEQ ID NO: 29702 - RNA, 1617 nt, Artificial Sequence
  derived and/or modified sequence opt5 from VP1__Norovirus_and/or_Norovirus-like__KU678203
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccaaccacgauuuugaagccaaucagaacaccaaauucacacccguuggggugauccaggacggaggcaccacacacagaaaugagccccaacaguggguccucccuagcuacuccggccggaacacgccgaaugugcaucuggcucccgccguggcgccuaccuuucccggggaacagcuucuguucuuucgcagcacaaugccuggauguucuggcuaucccaacauggaucucgacugccugcugccucaggaguggguucaauacuucuaucaggaggcugcccccgcccaguccgaugucgcucuccugagauuugugaauccggacaccgggcgggugcuuuucgaauguaagcugcacaaaagcggauacgucacaguggcccauaccggccagcacgaucucguuauuccucccaacggguauuuuagauucgacucuugggugaaccaauucuacacgcuggcuccuaugggcaauggaaccggccgccggagauga

SEQ ID NO: 29703 - RNA, 1617 nt, Artificial Sequence
  derived and/or modified sequence opt5 from VP1__Norovirus_and/or_Norovirus-like__KP176410
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaggcaccacacaucgcaacgagccccaacaguggguccucccuagcuacuccggcagaaauacgccgaacgugcaccuggcucccgccguggcgccuaccuuucccggggaacagcuucuguucuuucggagcacaaugccuggauguucuggcuaucccaauaccgaccucgauugccugcugccucaggaguggguucaauacuucuaucaggaggcugcccccgcccaguccgacgucgcucuccugagauuugugaacccggauacagggcgcgugcuuuucgaauguaagcugcacaaaagcggauacgucaccguggcccauacgggccagcacgaccucguuauuccucccaauggguauuuucgguucgauucuugggugaaccaauucuacacccuggcuccuaugggcaacggaacaggcagacgccgguga

SEQ ID NO: 29704 - RNA, 1617 nt, Artificial Sequence
  derived and/or modified sequence opt5 from VP1__Norovirus_and/or_Norovirus-like__KX371609
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacacggggcgacggguccacccgcggacacaaggcuacagucuacaccggcagcgccccguuuacgccuaagcucggguccgugcaguucgaaacagacaccgagaacgauuuugaaacccaucaaaauacaaaauucacccccguuggagugauucaggacggcggcacaacgcacagaaacgagccccagcaauggguccugccuucuuacagcgggcggaaugugccgaacguucaccuugcccccgcuguggccccuaccuuucccggagagcagcuccuguucuuucgcuccacaaugccuggcuguagcggguaucccaauauggaucuggacugccugcucccucaggaauggguccagcauuucuaccaagaggcggcucccgcccagucugauguggcccugcuuagauuugugaacccggacaccggacggguucuguucgaauguaagcuccacaaauccggcuaugucacaguggcucauaccgggcagcacgaucuggugaucccucccaacggcuacuuuagauucgacagcugggucaaucaguucuauacgcuugccccuaugggaaacggcaccgggcgccggagauga

SEQ ID NO: 29705 - RNA, 1617 nt, Artificial Sequence
  derived and/or modified sequence opt5 from VP1__Norovirus_and/or_Norovirus-like__KX354130
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagcggcuguucacagggccuucuuccgccuucgugguccagccccagaacggacgcuguaccacagauggcgugcuccuggggaccacgcaacugagcccugucaauauuugcacauuuagaggagacaucacccauauuacaggcucucacaacuacaccaugaaucucgcuucccagaacuggaauaacuaugaucccaccgaggaaaucccugcgccccugggcacaccggacuucguggggaagauccagggaguucuuacgcagaccacacggaccgacggcagcacacgcgggcauaaagccaccguguacacgggauccgcugaguuugccccuaagcugggcagaguccaauucgaaacagauaccaaucacgacuuugaggccaaccagaauaccaaguucacacccguggggguuauucaggauggaucuaccacacaccggaacgaaccccaacagugggugcucccuagcuacuccggccgcaauacgcauaacguccaccuggcuccggccguggcgcccaccuuuccuggcgagcagcuucuguucuuuagaagcacaaugcccggguguucuggauauccuaauauggaccucgauugccugcugccccaggagugggugcaauacuucuaucaggaagcugccccugcccaguccgacguugcucuccugcgguuugucaaccccgauaccggcagagugcuuuucgaguguaaacugcauaagagcggguacaucacaguggcccacaccggacagcacgaccucgucauuccgccuaacggcuauuuucgcuucgauucuugggugaaucaauucuacacgcuggcucccauggggaacggcaccggacggaaaagauga

SEQ ID NO: 29706 - RNA, 1617 nt, Artificial Sequence
  derived and/or modified sequence opt5 from VP1__Norovirus_and/or_Norovirus-like__KX354120
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggaaugcuuacgcagaccacacggaccgacggcuccacacgcgggcacaaggccaccguguacacgggaucugcugauuuugccccuaagcugggcagaguccaauucgagacagacaccgaucaugacuuugaagugaaccagaauaccaaauucacacccguuggggugauccaggauggaagcaccacacaccggaacgagccccaacaguggguccucccuuccuacagcggccgcaauacgccgaacgugcaccuggcccccgcuguggccccuaccuuucccggcgaacagcuucuguucuuuagaucuacaaugccuggguguuccggauaucccaauauggaccucgauugccugcugccucaggaguggguucaauacuucuaucaggaggcggcucccgcccagagcgacgucgcccuccugcgguuugugaacccggauaccggcagagugcuuuucgaauguaagcugcauaaaucuggguacgucacaguggcucacaccggacagcaugaccucguuauuccucccaauggcuauuuucgcuucgauagcugggugaaccaauucuacacgcuggccccuauggggaacggcaccggacggagacgcuga

SEQ ID NO: 29707 - RNA, 1617 nt, Artificial Sequence
  derived and/or modified sequence opt5 from VP1__Norovirus_and/or_Norovirus-like__KX354113
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagcggcuguucacagggccuuccagcgccuucgugguccagccccagaauggacgcuguaccacagauggcgugcuccuggggaccacgcaacugucuccugucaacauuugcacauuuagaggagacgugacccauaucacaggcucccggaauuacaccaugaaccucgcuagccagaauugguccaacuaugaucccaccgaggaaauuccugcgccccugggcacaccggacuucguugggaagauccagggagugcuuacgcagaccacacgcaccgacggcucuacaagagggcacaaagccaccgucuacacgggaagcgcugauuuugccccuaagcugggccgggugcaauucgagacagacaccgaucaugacuuugaagccaaucagaacaccaaguucacacccguuggggugauccaggauggaggcaccacacaccgcaaugagccccaacaguggguccucccuuccuacagcggcagaaacacgccgaaugugcaccuggcucccgccguggcgccuaccuuucccggggaacagcuucuguucuuucggucuacaaugccuggauguuccggcuaucccaacauggaccucgauugccugcugccucaggaguggguucaauacuucuaucaggaggcugcccccgcccagagcgacgucgcucuccugagauuugugaauccggauaccgggcgcgugcuuuucgaauguaaacugcauaagucuggauacgucacaguggcccacaccggccagcaugaccucguuauuccucccaacggguauuuucgguucgauagcugggugaaucaauucuacacgcuggcuccuaugggcaacggaaccggcagacgccgguga

SEQ ID NO: 29708 - RNA, 1617 nt, Artificial Sequence
  derived and/or modified sequence opt5 from VP1__Norovirus_and/or_Norovirus-like__KX354105
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaagcaccacacaucgcaacgagccccaacaguggguccucccuuccuacagcggcagaaauacgccgaacgugcaccuggcucccgccguggcgccuaccuuucccggcgaacagcuucuguucuuucggucuacaaugccuggguguuccggauaucccaauauggaccucgauugccugcugccucaggaguggguucaauacuucuaucaggaggcugcccccgcccagagcgacgucgcucuccugagauuugugaacccggauaccggccgcgugcuuuucgaauguaagcugcacaaaucuggguacgucacaguggcccauaccggacagcacgaccucguuauuccucccaauggcuauuuucgguucgauagcugggugaaccaauucuacacgcuggcuccuauggggaacggcaccggaagacgccgguga

SEQ ID NO: 29709 - RNA, 1617 nt, Artificial Sequence
  derived and/or modified sequence opt5 from VP1__Norovirus_and/or_Norovirus-like__KX354077
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacacggggcgacggguccacccgcggacacaaggcuacagucuacaccggcagcgccccguuuacgccuaagcucggguccgugcaguucgaaacagacaccgagaacgauuuugaaacccaucaaaauacaaaauucacccccguuggagugauucaggacggcggcacaacgcacagaaacgagccccagcaauggguccugccuucuuacagcgggcgguccgugccgaauguucaccuugcccccgcuguggccccuaccuuucccggagagcagcuccuguucuuucgcagcacaaugccuggcuguucuggguaucccaacauggaucuggacugccugcucccucaggaauggguccagcauuucuaccaagaggcggcucccgcccaguccgauguggcccugcuuagauuugugaauccggacaccggacggguucuguucgaauguaagcuccacaaaagcggcuaugucacaguggcucauaccgggcagcacgaucuggugaucccucccaacggcuacuuuagauucgacucuugggucaaccaguucuauacgcuugccccuaugggaaauggcaccgggcgccggagauga

SEQ ID NO: 29710 - RNA, 1617 nt, Artificial Sequence
  derived and/or modified sequence opt5 from VP1__Norovirus_and/or_Norovirus-like__KR131785
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuugccccuaagcugggccgcgugcaauucgagacagacaccaaucacgauuuugaagccaaccagaauaccaaauucacacccguuggggugauccaggacggaggcaccacacacagaaacgagccccaacaguggguccucccuucuuacagcggccggaauacgcauaacgugcaccuggcuccggccguggcgcccaccuuuccuggggaacagcuucuguucuuucgcuccacaaugcccggauguagcggcuauccuaauauggaucucgacugccugcugccccaggaguggguucaauacuucuaucaggaggcugccccugcccagucugaugucgcucuccugagauuugugaaccccgacaccgggcgggugcuuuucgaauguaagcugcauaaauccggauacgucacaguggcccacaccggccagcacgaucucguuauuccgccuaacggguauuuuagauucgacagcugggugaaucaauucuacacgcuggcucccaugggcaacggaaccggccgccggagauga

SEQ ID NO: 29711 - RNA, 1617 nt, Artificial Sequence
  derived and/or modified sequence opt5 from VP1__Norovirus_and/or_Norovirus-like__AB972530
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccacacaccggaacgagccccaacaguggguccucccuuccuacagcggccgcaauacgccgaacgugcaccuggcucccgccguggcgccuaccuuucccggcgaacagcuucuguucuuuagaucuacaaugccuggguguuccggauaucccaauauggaccucgauugccugcugccucaggaguggguucaauacuucuaucaggaggcugcccccgcccagagcgacgucgcucuccugcgguuugugaacccggauaccggcagagugcuuuucgaauguaagcugcauaaaucuggguacgucacaguggcccacaccggacagcaugaccucguuauuccucccaauggcuauuuucgcuucgauagcugggugaaccaauucuacacgcuggcuccuauggggaacggcaccggacggagacgcuga

SEQ ID NO: 29712 - RNA, 1617 nt, Artificial Sequence
  derived and/or modified sequence opt5 from VP1__Norovirus_and/or_Norovirus-like__AB972526
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuugccccuaagcugggccgcgugcaauucgagacagacaccgaucacgacuuugaagccaaucagaacaccaaauucacacccguuggggugauccaggauggaggcaccacacacagaaaugagccccaacaguggguccucccuucuuacagcggccggaacacgcauaaugugcaccuggcuccggccguggcgcccaccuuuccuggggaacagcuucuguucuuucgcuccacaaugcccggauguagcggcuauccuaacauggaccucgauugccugcugccccaggaguggguucaauacuucuaucaggaggcugccccugcccagucugacgucgcucuccugagauuugugaaucccgauaccgggcgggugcuuuucgaauguaagcugcauaaauccggauacgucacaguggcccacaccggccagcacgaccucguuauuccgccuaacggguauuuuagauucgauagcugggugaaccaauucuacacgcuggcucccaugggcaauggaaccggccgccggagauga

SEQ ID NO: 29713 - RNA, 1617 nt, Artificial Sequence
  derived and/or modified sequence opt5 from VP1__Norovirus_and/or_Norovirus-like__AB972522
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcuaacuuugccccuaagcugggcagaauccaauucgagacagauaccgaccaugauuuugaagccaaucagaacaccaaauucacacccguggggguuauucaggacggaagcaccacacaccggaaugagccccaacagugggugcucccuuccuacagcggccgcaacacgccgaauguccaccuggcucccgccguggcgccuaccuuucccggcgaacagcuucuguucuuuagaucuacaaugccuggguguuccggauaucccaacauggaucucgacugccugcugccucaggagugggugcaauacuucuaucaggaggcugcccccgcccagagcgauguugcucuccugcgguuugucaauccggacaccggcagagugcuuuucgaauguaagcugcauaaaucuggguacgugacagucgcccacaccggacagcaugaucucgugaucccucccaacggcuauuuucgcuucgacagcuggguuaaccaauucuacacgcuggcuccuauggggaauggcaccggacggagacgcuga

SEQ ID NO: 29714 - RNA, 1617 nt, Artificial Sequence
  derived and/or modified sequence opt5 from VP1__Norovirus_and/or_Norovirus-like__AB972514
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucgaaacagacaccgagaacgauuuugaaacccaucaaaauacaaaguucacccccguuggagugauucaggacggcggcacaacgcaccgcaacgagccccagcaauggguccugccuucuuacagcgggagaaaugugccgaacguucaccuugcccccgcuguggccccuaccuuucccggagagcagcuccuguucuuucgguccaucaugccuggcuguagcggguaucccaauauggaucuggacugccugcucccucaggaauggguccagcauuucuaccaagaggcggcucccgcccagucugauguggcccugcuucgcuuugugaacccggacacaggaagaguucuguucgaauguaaacuccacaaguccggcuaugucaccguggcucauacagggcagcacgaucuggugauuccucccaacggcuacuuucgguucgacagcugggucaaucaguucuauacccuugccccuaugggaaacggcacggggagacgccgguga

SEQ ID NO: 29715 - RNA, 1617 nt, Artificial Sequence
  derived and/or modified sequence opt5 from VP1__Norovirus_and/or_Norovirus-like__AB972505
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccgcucaccggaacgagccccaacaguggguccucccuuccuacagcggccgcaauacaccgaacgugcaccuggcccccgcgguggcuccuacguuucccggcgaacagcuucuguucuuuagaucuaccaugccuggguguuccggauaucccaauauggaccucgauugccugcugccucaggaguggguucaauacuucuaucaggaggccgcccccgcucagagcgacgucgcccuccugcgguuugugaacccggauacaggcagagugcuuuucgaauguaagcugcauaaaucuggguacgucaccguggcucacacaggacagcaugaccucguuauuccucccaauggcuauuuucgcuucgauagcugggugaaccaauucuacacccuggccccuauggggaacggcacgggacggagacgcuga

SEQ ID NO: 29716 - RNA, 1617 nt, Artificial Sequence
  derived and/or modified sequence opt5 from VP1__Norovirus_and/or_Norovirus-like__AB972473
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucgggacuuugaagccaaucagaacaccaaauucacacccguuggggugauccaggauggaucuaccacacaucgcaaugagccccaacaguggguccucccuagcuacuccggcagaaacacgcacaaugugcaccuggcuccggccguggcgcccaccuuuccuggcgaacagcuucuguucuuucggagcacaaugcccggguguucuggauauccuaacauggaccucgauugccugcugccccaggaguggguucaauacuucuaucaggaggcugccccugcccaguccgacgucgcucuccugagauuugugaaucccgauaccggccgcgugcuuuucgaauguaagcugcauaaaagcggguacgucacaguggcccacaccggacagcaugaccucguuauuccgccuaacggcuauuuucgguucgauucuugggugaaccaauucuacacgcuggcucccauggggaauggcaccggaagacgccgguga

SEQ ID NO: 29717 - RNA, 1617 nt, Artificial Sequence
  derived and/or modified sequence opt5 from VP1__Norovirus_and/or_Norovirus-like__KT780381
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggacauuccugcgccccugggcacaccggacuucguugggaaaauccagggagugcuuacgcagaccacacggaccgauggcuccacacgcgggcacaaggccaccgucuacacgggaucugcugacuuugccccuaagcugggcagagugcaauucgaaacagauaccgaccaugauuuugaggccaaccagaauaccaaauucacacccguuggggugauccaggacggaggcaccacacaccggaacgaaccccaacaguggguccucccuagcuacuccggccgcaauacgccgaacgugcaccuggcucccgccguggcgccuaccuuucccggggagcagcuucuguucuuuagaagcacaaugccuggauguucuggcuaucccaauauggaucucgacugccugcugccucaggaauggguucaauacuucuaucaggaggcugcccccgcccaguccgaugucgcucuccugcgguuugugaacccggacaccgggagagugcuuuucgaguguaagcugcauaaaagcggauacgucacaguggcccacaccggccagcaugaucucguuauuccucccaauggguauuuucgcuucgacucuugggugaaccaauucuacacgcuggcuccuaugggcaacggaaccggccggagacgcuga

SEQ ID NO: 29718 - RNA, 1617 nt, Artificial Sequence
  derived and/or modified sequence opt5 from VP1__Norovirus_and/or_Norovirus-like__KT780372
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugcuucuggcuggcaacgccuuuacagcggggaaaguuaucuucgccgcugugccucccaauuuuccuacggagggacucucccccucucaggucaccauguucccgcauauugugguggacgucagacaacuggagccuguucugaucccccucccugaugugcggaacaauuuuuaucacuacaaccagagcaaugaccccacaaucaagcugauugccaugcuuuauacaccccugcgcgcuaacaacgccggcgaugacguguucaccgucuccugcagagugcucacccggccuagcccggauuuugacuucaucuuucugguucccccuacaguggaaucucgcaccaaacccuucuccgucccugugcuuacgguugaggaaaugaccaauagcagauuucccauuccgcuggagaagcuguucacagggccuucuuccgccuucgugguccagccccagaacggacgguguaccacagauggcgugcugcuggggaccacgcaacucagcccugucaauaucugcacauuucgcggagacgugacccauauuacaggcucuagaaacuacaccaugaaucuggcuucccagaacuggagcaauuaugaucccaccgaggaaaucccugcgccccuuggcacaccggacuucguugggaaaauucagggagugcugacgcagaccacacggaccgacggcuccacacgcgggcacaaggccaccgucuacacgggaucugcugauuuugccccuaagcucggcagagugcaauucgagacagacaccgaucaugacuuugaagccaaccagaauaccaaauucacacccguuggggugauccaggauggaagcaccacacaccggaacgagccccaacaguggguccugccuuccuacagcggccgcaauacgccgaacgugcaccuugcucccgccguggcgccuaccuuucccggcgaacagcuccucuucuuuagaucuacaaugccuggguguuccggauaucccaauauggaccuggauugccugcucccucaggaguggguucaauacuucuaucaggaggcugcccccgcccagagcgacgucgcucugcuucgguuugugaacccggauaccggcagagugcuguucgaauguaagcuccauaaaucuggguacgucacaguggcccacaccggacagcaugaccugguuaucccucccaauggcuauuuucgcuucgauagcugggugaaccaauucuacacgcuugcuccuauggggaacggcaccggacggagacgcuga

SEQ ID NO: 29719 - RNA, 1617 nt, Artificial Sequence
  derived and/or modified sequence opt5 from VP1__Norovirus_and/or_Norovirus-like__KT202797
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccgauagagacuuugaagccaaccagaauaccaaauucacacccguuggggugauccaggauggaggcaccacacaccggaacgagccccaacaguggguccucccuagcuacuccggccgcagcacgccgaaugugcaccuggcucccgccguggcgccuaccuuucccggggaacagcuucuguucuuuagaucuacaaugccuggauguuccggcuaucccaacauggaccucgauugccugcugccucaggaguggguucaauacuucuaucaggaggcugcccccgcccagagcgacgucgcucuccugcgguuugugaauccggauaccgggagagugcuuuucgaauguaagcugcauaaaucuggauacgucacaguggcccacaccggccagcaugaccucguuauuccucccaacggguauuuucgcuucgauagcugggugaaucaauucuacacgcuggcuccuaugggcaacggaaccggccggagacgcuga

SEQ ID NO: 29720 - RNA, 1617 nt, Artificial Sequence
  derived and/or modified sequence opt5 from VP1__Norovirus_and/or_Norovirus-like__KR904226
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccugugcugacggucgaggaaaugaccaauagcagauuucccaucccgcuugagaagcuguucacagggccuucuuccgccuucgugguucagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaaucccugcgccccugggcacaccggacuucgucgggaaaauucagggaaugcuuacgcagaccacacggaccgacggcagcacacgcgggcacaaggccaccguguacacgggauccgcugauuuugccccuaagcugggcagaguucaauucgagacagacaccgaucaugacuuugaagccaaucagaacaccaaauucacacccgugggggucauccaggauggaucuaccacacaccggaaugagccccaacagugggugcucccuagcuacuccggccgcagcgcucacaacguucaucuggccccggcgguggcucccacguuuccuggcgaacagcuucuguucuuuagaucuaccaugcccggguguuccggauauccuaauauggaccucgauugccugcugccccaggaguggguccaauacuucuaucaggaggccgccccugcucagagcgacguggcccuccugcgguuugugaaccccgauacaggcagaguucuuuucgaauguaagcugcacaaaucuggguacgucaccguggcucauacaggacagcacgaccucgugauuccgccuaauggcuauuuucgcuucgauagcugggucaaccaauucuacacccuggcccccauggggaacggcacgggacggagacgcuga

SEQ ID NO: 29721 - RNA, 1617 nt, Artificial Sequence
  derived and/or modified sequence opt5 from VP1__Norovirus_and/or_Norovirus-like__KR904208
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuguuuucuccgccgugccucccaauuuuccuacggagggacugucucccagccaggucaccauguucccgcauaucaucguggacgugagacaacucgagccuguccugauuccccugccugauguucggaacaauuuuuaucacuacaaccaguccaaugaccccacaaucaagcucauugcuaugcuguauacaccccuucgcgccaacaacgcuggcgaugacguguucaccgugagcugcagaguccugacccggccuucuccggauuuugacuucaucuuucucgugcccccuacaguugaaucccgcaccaaacccuucagcgugccuauucugacggucgaggaaaugaccaauucuagauuucccaucccgcuugagaagcuguucacagggccuuccagcaccuucgugguucagccccagaacggacgguguacaaccgauggcgugcuccuggggacgacacaacugucuccugucaauauuugcaccuuucgcggagacgugacacauaucgccggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugaugccaaucagaacaccaaauucacacccgucggggugauccaggacggaaauaccgcccaucggaacgagccccaacaguggguucucccuagcuacucuggccgcaauacacacaacgugcaccuggcuccggccgucgcgcccacguuuccuggcgaacagcuucuguucuuuagauccaccaugcccggguguagcggauauccuaauauggaucucgacugccugcugccccaggagugggugcaauacuucuaucaggaagcugccccugcccagucugauguggcucuccugcgguuuguuaaccccgacacaggcagaguccuuuucgaguguaagcugcauaaaagcggguacgugaccguggcccacacaggacagcaugaucucgucauuccgccuaacggcuauuuucgcuucgacuccugggugaaucacuucuacacccuggcucccguugggaacggcacgggacggagacgcuga

SEQ ID NO: 29722 - RNA, 1617 nt, Artificial Sequence
  derived and/or modified sequence opt5 from VP1__Norovirus_and/or_Norovirus-like__AB933709
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaaugcugacgcagaccacaaagggcgacgggagcacccggggacacaaggcuacagucuacaccggcuccgccccguuuacgccuaaacucgggucugugcaguucagcacagacaccgaaaaugauuuugagacccaucaaaacacaaaguucacccccguuggagugauucacgacggcuccacaacgcaccgcaaugaaccccagcaguggguccugccuagcuacucuggcagaaacgugccgaauguucaucuugcccccgcuguggccccuaccuuucccggggagcaacuccuguucuuucgguccacaaugccuggauguagcggcuaucccaacauggaucuggacugccugcucccucaggaguggguccagcacuucuaccaggaagcggcucccgcccaaucugauguggcccugcuucgcuuugugaauccggacaccgggagaguucuguucgaguguaaacuccauaagagcggauaugucacaguggcucacaccggccagcacgaucuggugaucccucccaacggguacuuucgguucgacuccugggucaaccaguucuauacgcuugccccuaugggcaauggaaccggcagacgccgguga

SEQ ID NO: 29723 - RNA, 1617 nt, Artificial Sequence
  derived and/or modified sequence opt5 from VP1__Norovirus_and/or_Norovirus-like__EU921352
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagcggcuguucaccgggccguccagcgccuucgucgugcagccucagaacggacgcuguacaaccgauggcguucuccuggggacgacacaacugucucccgugaauaucugcaccuuuagaggagacgucacacauaucgccggcacccaggaguacaccaugaaccucgcuucccagaauuggaacaauuaugauccuacagaagagauucccgcgccucugggcacgcccgacuucguggggaagauccagggaguccuuacccaaacaacccggcgcgacggcagcacaagagggcacaaagccaccguguccacgggaucuguucauuuuacaccgaagcugggccggauucaguucagcaccgauaccuccaacgacuuugaaacagggcagaauacccgcuucacaccugugggagucgugcaagauggcggcacgacccaccagaacgagccccagcaguggguucuccccgacuacagcgggagagauggacacaaugugcaucuggcuccugccgucgccccgucuuuucccggcgaacaacuucuguucuuucgguccacaaugccuggguguagcggauaccccaacaugaaucucgacugccugcugccucaggagugggugcagcacuucuaucaggaggcugcccccgcgcaaucugauguggcucuccugagauuuguuaacccugacaccggccgcguccuuuucgaauguaagcugcauaaaagcggguacgugacaguggcccacaccggccagcacgaucucgucauucccccgaauggauauuuucgguucgacuccugggugaaccaguucuacacgcuggccccuaugggcaacgggaccggaagacgccgguga

SEQ ID NO: 29724 - RNA, 1617 nt, Artificial Sequence
  derived and/or modified sequence opt5 from VP1__Norovirus_and/or_Norovirus-like__LC005735
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuuccuacagcggccgcaacacgccgaaugugcaccuggcucccgccguggcgccuaccuuucccggggaacagcuucuguucuuuagaucuacaaugccuggauguuccggcuaucccaacauggaccucgauugccugcugccucaggaguggguucaauacuucuaucaggaggcugcccccgcccagagcgacgucgcucuccugcgguuugugaauccggauaccgggagagugcuuuucgaauguaagcugcauaaaucuggauacgucacaguggcccacaccggccagcaugaccucguuauuccucccaacggguauuuucgcuucgauagcugggugaaucaauucuacacgcuggcuccuaugggcaacggaaccggccggagacgcuga

SEQ ID NO: 29725 - RNA, 1617 nt, Artificial Sequence
  derived and/or modified sequence opt5 from VP1__Norovirus_and/or_Norovirus-like__KP241909
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaaaccaaccagaauacaaaauucacccccguuggggugauccaggauggaggcacaacgcaccggaacgagccccaacaguggguccucccuagcuacuccggccgcaauaccccgaacgugcaccuggcccccgcuguggccccuacauuucccggggaacagcuucuguucuuuagaagcaccaugccuggauguucuggcuaucccaauacagaccucgauugccugcugccucaggaguggguucaauacuucuaucaggaggcggcucccgcccaguccgacgucgcccuccugcgguuugugaacccggauaccgggagagugcuuuucgaauguaagcugcauaaaagcggauacgucacgguggcucacaccggccagcaugaccucguuauuccucccaauggguauuuucgcuucgauucuugggugaaccaauucuacacacuggccccuaugggcaacggaaccggccggagacgcuga

SEQ ID NO: 29726 - RNA, 1617 nt, Artificial Sequence
  derived and/or modified sequence opt5 from VP1__Norovirus_and/or_Norovirus-like__KJ533132
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggaggcugccccugcccagucugacgucgcucuccugcgguuugugaaucccgauaccgggagagugcuuuucgaauguaagcugcacaaauccggauacgucacaguggcccauaccggccaguaugaccucguuauuccgccuaacggguacuuucgcuucgauagcugggugaaccaauucuauacgcuggcucccaugggcaauggaaccggccggagacgcuga

SEQ ID NO: 29727 - RNA, 1617 nt, Artificial Sequence
  derived and/or modified sequence opt5 from VP1__Norovirus_and/or_Norovirus-like__KP176407
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaacugaaccccuaccucagccaccuggcucgcauguauaauggguacgccggaggcuucgagguccaggugauccuugcuggcaacgccuuuacagcggggaaaguuauuuucgccgcugugccucccaauuuuccuacggagggacugucccccucucaggucaccauguucccgcauaucgugguggaugucagacaacucgaaccuguucugaucccccugccugacgugcggaacaauuuuuaucacuacaaccagagcaaugaucccacaauuaagcucaucgccaugcuguauacaccccuucgcgcuaacaacgccggcgacgauguguucaccgucuccugcagagugcugacccggccuagcccggacuuugauuucauuuuucucguucccccuacaguggagucucgcaccaaacccuucuccgucccugugcugacgguugaagagaugaccaauagcagauuucccaucccgcuugagaagcuguucacagggccuucuuccgccuucgugguccagccccagaacggacgguguaccacagacggcgugcuccuggggaccacgcaacugagcccugucaauauuugcacauuucgcggagaugugacccauaucacaggcucuagaaacuacaccaugaaucucgcuucccagaacuggagcaauuaugaccccaccgaagagauuccugcgccccugggcacaccggauuucguugggaaaauccagggagugcuuacgcagaccacacggaccgacggcuccacacgcgggcacaaggccaccgucuacacgggaucugcugacuuugccccuaagcugggcagagugcaauucgaaacagauaccgaccgggauuuugaggccaaccagaauaccaaauucacacccguuggggugauccaggacggaagcaccacacaucgcaacgaaccccaacaguggguccucccuuccuacagcggcagaaauacgccgaacgugcaccuggcucccgccguggcgccuaccuuucccggcgagcagcuucuguucuuucggucuacaaugccuggguguuccggauaucccaauagagaucucgacugccugcugccucaggaguggguucaauacuucuaucaggaagcugcccccgcccagagcgaugucgcucuccugcgcuuugugaacccggacaccggccgggugcuuuucgaguguaagcugcacaaaucuggguacgucacaguggcccauaccggacagcacgaucucguuauuccucccaauggcuauuuuagauucgacagcugggugaaccaauucuacacgcuggcuccuauggggaacggcaccggacgccggagauga

SEQ ID NO: 29728 - RNA, 1617 nt, Artificial Sequence
  derived and/or modified sequence opt5 from VP1__Norovirus_and/or_Norovirus-like__KP176406
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccuauccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggagcaauuaugaucccaccgaggaaaucccugcgccccugggcaucccggacuucguggggaaaauucagggaaugcuuacacagacgacccggacagacggcuccacccgcgggcacaaggccacaguuuacaccggaucugcugauuuugccccuaagcugggcagagugcaauucgagacggacacagaucaugacuuugaagccaaccagaauaccaaauucacccccgucggggugauccaggauggaagcacaacccaccggaacgagccccaacaguggguucucccuuccuacagcggccgcaauacaccgaacgugcaccuggcucccgccgucgcgccuacguuucccggcgaacagcuucuguucuuuagaucuaccaugccuggguguuccggauaucccaauauggaccucgauugccugcugccucaggagugggugcaauacuucuaucaggaggcugcccccgcccagagcgacguggcucuccugcgguuuguuaacccggauacaggcagaguccuuuucgaauguaagcugcauaaaucuggguacgugaccguggcccacacaggacagcaugaccucgucauuccucccaauggcuauuuucgcuucgauagcugggugaaccaauucuacacccuggcuccuauggggaacggcacgggacggagacgcuga

SEQ ID NO: 29729 - RNA, 1617 nt, Artificial Sequence
  derived and/or modified sequence opt5 from VP1__Norovirus_and/or_Norovirus-like__KP123606
augaagauggccagcuccgacgcuaaccccucugauggcagcgccgcgaaucuggugccugaggucaacaaugaaguuauggcucucgagccgguggugggggccaccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaguuauuuucgcggccgugccucccaauuuuccuaccgagggacugucccccucucaggucacaauguucccgcauaucgugguggacgucagacaacucgagccuguucugaucccccugccugaugugcggaacaauuuuuaucacuacaaccagagcaaugaccccaccauuaagcucaucgcuaugcuguauacaccccuucgcgccaacaacgcuggcgaugacguguucaccgucuccugcagagugcugacacggccuagcccggauuuugacuucauuuuucucguucccccuaccguggaaucucgcacgaaacccuucuccgucccuauccugaccguggaggaaaugacaaauagcagauuucccauuccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauuaccggcucuagaaacuacaccaugaaucucgccucccagaacuggagcaauuaugaucccacagaggaaaucccugcuccccugggcaucccggacuucguggggaaaauucagggaaugcuuacgcagaccacacggaccgacggcuccacacgcgggcacaaggcgaccguuuacacgggaucugccgauuuugcuccuaagcugggcagagugcaauucgagacagacaccgaucaugacuuugaagccaaccagaauaccaaauucacacccgucggggugauccaggauggaagcaccacacaccggaacgagccccaacaguggguucucccuuccuacagcggccgcaauacgccgaacgugcaccuggcccccgcugucgccccuaccuuucccggcgaacagcuucuguucuuuagaucuacaaugccuggguguuccggauaucccaauauggaccucgauugccugcugccucaggagugggugcaauacuucuaucaggaggcggcucccgcccagagcgacguggcccuccugcgguuuguuaacccggauaccggcagaguccuuuucgaauguaagcugcauaaaucuggguacgugacaguggcucacaccggacagcaugaccucgucauuccucccaauggcuauuuucgcuucgauagcugggugaaccaauucuacacgcuggccccuauggggaacggcaccggacggagacgcuga

SEQ ID NO: 29730 - RNA, 1617 nt, Artificial Sequence
  derived and/or modified sequence opt5 from VP1__Norovirus_and/or_Norovirus-like__KP096335
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucaccucccagaacuggagcaauuaugaucccacagaggaaauuccugcuccccugggcacgccggacuucguugggaaaauccagggaaugcuuacccagacaacccggacagacggcuccacccgcgggcacaaggcgacgguguacacaggaucugccgauuuugcuccuaagcugggcagaguccaauucgagaccgacaccgaucaugacuuugaagccaaccagaauacaaaauucacccccguggggguuauccaggauggaagcacaacgcaccggaacgagccccaacagugggugcucccuuccuacagcggccgcaauaccccgaacguccaccuggcccccgcuguggccccuacauuucccggcgaacagcuucuguucuuuagaucuaccaugccuggguguuccggauaucccaauauggaccucgauugccugcugccucaggagugggugcaauacuucuaucaggaggcggcucccgcccagagcgacguugcccuccugcgguuugucaacccggauacaggcagagugcuuuucgaauguaagcugcauaaaucuggguacgugaccgucgcucacacgggacagcaugaccucgugauuccucccaauggcuauuuucgcuucgauagcuggguuaaccaauucuacacccuggccccuauggggaacggcacaggacggagacgcuga

SEQ ID NO: 29731 - RNA, 1617 nt, Artificial Sequence
  derived and/or modified sequence opt5 from VP1__Norovirus_and/or_Norovirus-like__KM268095
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaaaccaaccagaauacaaaauucacccccguuggggugauccaggauggaagcacaacgcaccggaacgagccccaacaguggguccucccuuccuacagcggccgcaauaccccgaacgugcaccuggcccccgcuguggccccuacauuucccggcgaacagcuucuguucuuuagaucuaccaugccuggguguuccggauaucccaauauggaccucgauugccugcugccucaggaguggguucaauacuucuaucaggaggcggcucccgcccagagcgacgucgcccuccugcgguuugugaacccggauacaggcagagugcuuuucgaauguaagcugcauaaaucuggguacgucaccguggcucacacgggacagcaugaccucguuauuccucccaauggcuauuuucgcuucgauagcugggugaaccaauucuacacccuggccccuauggggaacggcacaggacggagacgcuga

SEQ ID NO: 29732 - RNA, 1617 nt, Artificial Sequence
  derived and/or modified sequence opt5 from VP1__Norovirus_and/or_Norovirus-like__KM268094
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccuauccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggagcaauuaugaucccaccgaggaaaucccugcgccccugggcacaccggacuucguggggaaaauccagggaguucuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauucaggauggaagcaccacacaccggaacgagccccaacagugggugcucccuuccuacagcggccgcaauacgccgaacguccaccuggcucccgccguggcgccuaccuuucccggcgaacagcuucuguucuuuagaucuacaaugccuggguguuccggauaucccaauauggaccucgauugccugcugccucaggagugggugcaauacuucuaucaggaggcugcccccgcccagagcgacguugcucuccugcgguuugucaacccggauaccggcagagugcuuuucgaauguaagcugcauaaaucuggguacgugacagucgcccacaccggacagcaugaccucgugaucccucccaauggcuauuuucgcuucgauagcuggguuaaccaauucuacacgcuggcuccuauggggaacggcaccggacggagacgcuga

SEQ ID NO: 29733 - RNA, 1617 nt, Artificial Sequence
  derived and/or modified sequence opt5 from VP1__Norovirus_and/or_Norovirus-like__KM268093
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagauccaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuuccuacagcggccgcaacacgccgaaugugcaccuggcucccgccguggcgccuaccuuucccggggaacagcuucuguucuuuagaucuacaaugccuggauguuccggcuaucccaacauggaccucgauugccugcugccucaggaguggguucaauacuucuaucaggaggcugcccccgcccagagcgacgucgcucuccugcgguuugugaauccggauaccgggagagugcuuuucgaauguaagcugcauaaaucuggauacgucacaguggcccacaccggccagcaugaccucguuauuccucccaacggguauuuucgcuucgauagcugggugaaucaauucuacacgcuggcuccuaugggcaacggaaccggccggagacgcuga

SEQ ID NO: 29734 - RNA, 1617 nt, Artificial Sequence
  derived and/or modified sequence opt5 from VP1__Norovirus_and/or_Norovirus-like__KM198591
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagagauguucacaacgugcaucuugccccggcugucgcccccacauuuccuggcgagcagcuccuguucuuucgguccaccaugcccggguguagcggauauccuaauauggaccuggauugccugcucccccaggagugggugcagcacuucuaccaagaagcggcuccugcccagucugacguggcccugcuucgcuuuguuaaccccgauacaggcagaguccuguucgaguguaaacuccauaaguccggguaugugaccguggcucacacgggccagcacgaccuggucaucccgccuaauggauacuuucgguucgauagcugggugaaccaguucuauacccuugcccccaugggcaacgggacaggaagacgccgguga

SEQ ID NO: 29735 - RNA, 1617 nt, Artificial Sequence
  derived and/or modified sequence opt5 from VP1__Norovirus_and/or_Norovirus-like__KM198589
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucagagugauccuugcuggcaacgccuuuacagcggggaaaauuaucuucgccgcuguuccucccaauuuuccuacggagggacugucccccucucaggugaccauguucccgcauaucauugucgacgugcggcagcucgagccugugcugaucccccugccugauguccgcaacaauuuuuaucacuacaaccaaacaaaugacagcaccauuaagcucaucgccaugcuguauacaccccuuagagcuaacaacgccggcgaagauguuuucaccguguccugccgggugcugacacgccccagcccugacuuugauuucauuuuucucgucccgcccaccguggagucuagaacgaaaccuuucaccguucccauccugacaguggaagagaugaccaauucccgguuuccuauuccccuugagaagcuguucacagggccgagcggagccuucgucgugcagccucagaacggccgcuguaccacggacgggguucuccugggaacaacccagcugucucccgugaauaucugcacauuuagaggcgaugucacccauaucgcuggcucccggaacuacaccaugaaucucgcgagccugaacuggaauaacuaugacccuacagaagagauucccgccccucuugggacgcccgauuucgugggaaaaauccaaggcguccugacccagacaaccaagggggacggaucuacacgcggccacaaggcuaccguguacacgggguccgccccguuuacaccuaaacucggaagcguucaguucuccaccgacaccgaaaaugauuuugagauucaucagaacacaaaguucacccccgugggcgucauccaagacggcgggacaacgcacagaaaugaaccccagcagugggugcugccuucuuacagcggacgggauguucacaacgugcaucuugccccggcugucgcccccaccuuuccuggcgagcaacuccuguucuuucgcuccacaaugcccggguguagcggauauccuaauauggaccuggauugccugcucccccaggagugggugcagcacuucuaccaggaagcggcuccugcccaaucugacguggcccugcuuagauuuguuaaccccgauaccggccggguccuguucgaguguaaacuccauagauccggguaugugacaguggcucacaccggccagcacgaccuggucauuccgccuaauggauacuuucgcuucgauagcugggugaaccaguucuauacgcuugcccccaugggcaacgggaccggacggagacgcuga

SEQ ID NO: 29736 - RNA, 1617 nt, Artificial Sequence
  derived and/or modified sequence opt5 from VP1__Norovirus_and/or_Norovirus-like__KM198576
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucaucguccagccucagaauggccgguguacaaccgacggggugcuccugggaacgacacaacugucucccguuaacaucugcaccuuucgcggcgaugugacacauauugcuggcuccagaaauuacaccaugaaccucgcgagccugaauuggaacaauuaugacccuaccgaagagauccccgccccucuugggacacccgauuucgucggaaaaauucagggcgugcugacgcagaccacaaagggggacggaucuacccggggccacaaggcuacagucuacaccggguccgccccguuuacgccuaaacucggaagcgugcaguucuccacagacaccgaaaacgauuuugaggcccaucaaaauaccaaguucacacccguuggcgugauccaggacggcgggaccacacaccgcaacgaaccccagcaauggguccugccuucuuacagcggaagagaugugcacaauguucaucuugcuccggccguggcgcccacguuuccuggcgagcagcuccuguucuuucgguccaccaugcccggguguagcggauauccuaacauggaccuggauugccugcucccccaggaguggguccagcacuucuaccaagaagcugccccugcccagucugacguggcucugcuucgcuuugugaaucccgauacaggcagaguucuguucgaguguaaacuccauaagccgggguaugucaccguggcccacacaggccagcacgaccuggugauuccucccaacggauacuuucgguucgauuccugggucaaccaguucuauacccuugcuccuaugggcaaugggacgggaagacgccgguga

SEQ ID NO: 29737 - RNA, 1617 nt, Artificial Sequence
  derived and/or modified sequence opt5 from VP1__Norovirus_and/or_Norovirus-like__KM198564
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucaucguccagccucagaauggccgguguacaaccgacggggugcuccugggaacgacacaacugucucccguuaacaucugcaccuuucgcggcgaugugacacauauugcuggcuccagaaauuacaccaugaaccucgcgagccugaauuggaacaauuaugacccuaccgaagagauccccgccccucuugggacacccgauuucgucggaaaaauucagggcgugcugacgcagaccacaaagggggacggaucuacccggggccacaaggcuacagucuacaccgggggagccccguuuacgccuaaacucggcuccgugcaguucagcacagacaccgaaaacgauuuugaggcccaucaaaauaccaaguucacacccguuggcgugauccaggacgggggaaccacacaccgcaacgaaccccagcaauggguccugccuuccuacucuggcagagaugugcacaauguucaucuugcuccggccguggcgcccacguuuccuggggagcagcuccuguucuuucggagcaccaugcccggauguuccggcuauccuaacauggaccuggauugccugcucccccaggaguggguccagcacuucuaccaagaagcugccccugcccagagcgacguggcucugcuucgcuuugugaaucccgauacagggagaguucuguucgaguguaaacuccauaagucuggcuaugucaccguggcccacacaggacagcacgaccuggugauuccgccuaacggcuacuuucgguucgauuccugggucaaccaguucuauacccuugcucccauggggaauggaacgggcagacgccgguga

SEQ ID NO: 29738 - RNA, 1617 nt, Artificial Sequence
  derived and/or modified sequence opt5 from VP1__Norovirus_and/or_Norovirus-like__KJ716355
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccuauccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggaauaacuaugaucccaccgaggaaaucccugcgccccugggcacaccggacuucguggggaaaauccagggaguucuuacgcagaccacacggaccgacggcagcacacgcgggcacaaggccaccguguacacgggauccgcugauuuugccccuaagcugggcagaguccaauucgagacagacaccgaucaugacuuugaagccaaucagaacaccaaauucacacccguggggguuauucaggauggaggcaccacacaccggaaugagccccaacagugggugcucccuucuuacagcggccgcaacacgcacaauguccaucuggcuccggccguggcgcccaccuuuccuggggaacagcuucuguucuuuagauccacaaugcccggauguagcggcuauccuaacauggaccucgauugccugcugccccaggagugggugcaauacuucuaucaggaggcugccccugcccagucugacguugcucuccugcgguuugucaaucccgauaccgggagagugcuuuucgaauguaagcugcacaaauccggauacgugacagucgcccauaccggccagcacgaccucgugaucccgccuaacggguauuuucgcuucgauagcuggguuaaccaauucuacacgcuggcucccaugggcaauggaaccggccggagacgcuga

SEQ ID NO: 29739 - RNA, 1617 nt, Artificial Sequence
  derived and/or modified sequence opt5 from VP1__Norovirus_and/or_Norovirus-like__KJ685408
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccagacgauccuugccggcaacgcuuuuaccgccgggaaaauuaucuucgcggccgugccucccaauuuuccuacagagggacugucccccucucagguuaccauguucccgcauaucauuguggacgucagacaacucgagccugugcugaucccccugccugaugugcggaacaauuuuuaucacuacaaccagacaaaugaccccaccauuaagcucaucgcuaugcuguauacaccccuucgcgccaacaacgcuggcgaugacgucuucaccguuagcugcagagugcugacgcggccuuccccggauuuugacuucauuuuucucgugcccccuaccgucgaaagccgcacaaaacccuucucugugccuguucugaccguggaggaaaugacaaauuccagauuucccaucccgcuugagaagcuguucaccgggccuagcucugccuucgucgugcagccccagaacggacgguguacgacagauggcguucuccuggggaccacacaacuguccccugugaauauuugcaccuuucgcggagacgucacccauaucagcggcucuagaaacuacacaaugaaucucgccucccagaacuggaauagcuaugaucccacggaggaaaucccugcuccccugggcaccccggacuucguggggaaaauucagggaguccuuacacagaccacacggaccgacggcuccacgcgcgggcacaaggcgacaguguacaccggaucugccgauuuuagcccuaagcugggcagaguucaauucgcuaccgacacagauaacgacuuugagaccaaucagaacacaaaauucacgcccgugggggucauccaggauggaggcaccacacaucaaaaugaaccccagcagugggugcucccuuccuacagcggccgggacacccacaacguucaccuggccccggccguggcucccacauuuccuggggagcagcuucuguucuuucgcucuaccaugcccggauguuccggcuauccuaauauggaucucgacugccugcugccccaagaauggguccaguacuucuaucaggaggccgcgccugcucagagcgauguggcccuccugagauuugugaaccccgacacggggcggguucuuuucgaguguaagcugcauaaaucuggauacgucaccguggcccacacaggccaacaugaucucgugauuccgccuaauggguauuuuagauucgacagcugggucaaccaguucuacacccuggcucccaugggcaacggaacaggccgccggagauga

SEQ ID NO: 29740 - RNA, 1617 nt, Artificial Sequence
  derived and/or modified sequence opt5 from VP1__Norovirus_and/or_Norovirus-like__KJ144999
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccgggggagccccguuuacgccuaaacucggcuccguucaguucagcacagacaccgaaaacgauuuugagacccaucaaaauacaaaguucacccccgugggcgucauucaggacggguccacaacgcaccgcaacgaaccccagcaaugggugcugccuaauuacucuggaagaaacguucacaaugugcaucuugccccggcugucgcccccaccuuuccuggcgagcagcuccuguucuuucggagcacaaugcccggguguuccggauauccuaacauggaucuggacugccugcucccccaggagugggugcagcacuucuaccaagaagcggcuccugcccagagcgauguggcccugcuucgcuuuguuaaccccgacaccggcagaguccuguucgaguguaaacuccauaagucuggguaugugacaguggcucacaccggccagcacgaucuggucaucccgccuaauggauacuuucgguucgacuccugggugaaccaguucuauacgcuugcccccaugggcaauggggcuggaagacgccgguga

SEQ ID NO: 29741 - RNA, 1617 nt, Artificial Sequence
  derived and/or modified sequence opt5 from VP1__Norovirus_and/or_Norovirus-like__KF060016
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccgugccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauuaccggcucuagaaacuacaccaugaaucucgccucccagaacuggaauagcuaugaucccacagaggaaaucccugcuccccugggcacgccggacuucguggggaaaauccagggaguucuuacccagacaacccggacaaacggcuccacccgcgggcacaaggcgacgguguacacaggaucugccgacuuuagcccuaagcugggcagaguccaauucgcuaccgauaccgacaaugauuuugagacaaaccagaauaccaaauucacacccguggggguuauucaggacggauccacgacaccccggaacgaaccucaacagugggugcucccgagcuacucuggccgcaauauccauaacguccaccuggcccccgccguggcuccuaccuuucccggcgagcagcuucuguucuuuagauccaccaugccuggguguagcggauaucccaauauggaucucgacugccugcugccucaggaaugggugcaauacuucuaucaggaggccgcgcccgcucagucugauguugcccuccugcgguuugucaacccggacacaggcagagugcuuuucgaguguaagcugcacaaaagcggguacgugaccgucgcccauacgggacagcacgaucucgugauuccucccaacggcuauuuucgcuucgacuccuggguuaaucaauucuacacccuggcuccuauggggaacggcacaggacggagacgcuga

SEQ ID NO: 29742 - RNA, 1617 nt, Artificial Sequence
  derived and/or modified sequence opt5 from VP1__Norovirus_and/or_Norovirus-like__KC517367
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccgccuccugcagagugcugacccggcccagcccugacuuugauuucauuuuucucgugccgcccacagucgagucucgcaccaaaccuuucacggugcccauccugaccguugaagagaugacaaacuccagauuuccuauuccccuugagaagcuguucaccgggccgagcucugcuuucgugguccagccucagaauggacgguguacaaccgacggcgugcuccuggggacgacacaacugucccccguuaacaucugcaccuuucgcggagaugugacacauaucgcgggcagcagaaauuacaccaugaaccucgccucucugaauuggaacaauuaugacccuaccgaagagauucccgcuccucuuggcacacccgauuucgucgggaaaauccagggaaugcugacgcagaccacaaagggcgacggguccacccggggacacaaggccacaguguacaccggcagcgccccguuuacgccuaaacucggguccguccaguucgaaacagacaccgagaacgauuuugaaacccaucaaaauacaaaguucacccccgugggaguuauucaggacggcggcacagcucaccgcaacgagccccagcaaugggugcugccuucuuacagcgggagaaaugucccgaacgugcaccuugcccccgcgguugcuccuacguuucccggagagcagcuccuguucuuucgguccaccaugccuggcuguagcggguaucccaauauggaucuggacugccugcucccucaggaaugggugcagcauuucuaccaagaggccgcccccgcucagucugaugucgcccugcuucgcuuugugaacccggacacaggaagagugcuguucgaauguaaacuccacaaguccggcuauguuaccgucgcucauacagggcagcacgaucuggugaucccucccaacggcuacuuucgguucgacagcugggugaaucaguucuauacccuugccccuaugggaaacggcacggggagacgccgguga

SEQ ID NO: 29743 - RNA, 1617 nt, Artificial Sequence
  derived and/or modified sequence opt5 from VP1__Norovirus_and/or_Norovirus-like__KC517366
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaacucugcgucccucaauuggaacaauuaugacccuaccgaagagauucccgccccucugggcacacccgauuucguggggaaaauccagggaaugcuuacgcagaccacaaagggcgacgggagcacccggggacacaaggcuacagucuacaccggcuccgccccguuuacgccuaaacuggggucugugcaguucgaaacagacaccgagaacgauuuugaaacccaucaaaauacaaaguucacccccguuggagugauucaggacggcggcacaacgcaccgcaacgagccccagcaauggguccucccuagcuacuccgggagaaaugugccgaacguucaccuggcccccgcuguggccccuaccuuucccggagagcagcuucuguucuuucggagcacaaugccuggcuguucuggguaucccaauauggaucucgacugccugcugccucaggaauggguccagcauuucuaccaagaggcggcucccgcccaguccgauguggcccuccugcgcuuugugaacccggacaccggaagaguucuuuucgaauguaaacugcacaagagcggcuaugucacaguggcucauaccgggcagcacgaucucgugaucccucccaacggcuacuuucgguucgacucuugggucaaucaguucuauacgcuggccccuaugggaaacggcaccgggagacgccgguga

SEQ ID NO: 29744 - RNA, 1617 nt, Artificial Sequence
  derived and/or modified sequence opt5 from VP1__Norovirus_and/or_Norovirus-like__KC517359
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacggcucgagccugugcugaucccccugccugauguccgcaacaauuuuuaucacuacaaccaaagcaaugacuccacaauuaagcucaucgccaugcuguauacaccccuuagagcuaacaacgccggcgaagauguuuucaccgugagcugccgggugcugacccgccccucuccugacuuugauuucauuuuucucgucccgcccacaguggaguccagaaccaaaccuuucacgguucccauccugaccguggaagagaugacauacagccgguuuccuauuccccuugagaagcuguucaccgggccgucuuccgccuucgucgugcagccucagaauggacgcuguacaaccgacggcguucuccuggggacgacacagcugagccccgugaacaucugcaccuuuagaggagaugucacacauaucgcuggcucucggaauuauaccaugaaccucgcgucccugaauuggaacaauuacgacccuaccgaagagauucccgccccucuuggcacacccgauuucguggggaaaauccaaggaaugcugacgcagaccacaaagggcgacgggagcacccgcggacacaaggcuacagucuacaccggcuccgccccguuuacgccuaaacucgggucugugcaguucgaaacagacaccgagaacgauuuugaaacccaucagaauauuaaguucacacccguuggagugauccaagacggcggcaccacacacagaaacgagccccagcaguggguccugccuagcuauuccgggcggaaugugccgaacguucaccuugcccccgcuguggccccuacguuucccggagagcaacuccuguucuuucgcagcaccaugccuggcuguucuggguaccccaauauggaucuggacugccugcucccucaggaauggguccagcauuucuaucaggaggcggcucccgcccaauccgauguggcccugcuuagauuugugaacccggacacaggacggguucuguucgaauguaaacuccacaagagcggcuacgucaccguggcucauacagggcagcacgaucugauuaucccucccaauggcuauuuuagauucgacucuugggugaaccaguucuacacccuugccccuaugggaaacggcacggggcgccggagauga

SEQ ID NO: 29745 - RNA, 1617 nt, Artificial Sequence
  derived and/or modified sequence opt5 from VP1__Norovirus_and/or_Norovirus-like__KC409303
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugagaccaaucagaacacaaaauucacccccgucggggugauccaggauggaggcacaacgcaucggaaugaaccccaacaguggguucucccuagcuacucuggccgcaacauucacaaugugcaccuggccccggccgucgcucccaccuuuccuggggagcagcuucuguucuuuagauccacaaugcccggauguagcggcuauccuaacauggaccucgauugccugcugccccaggaaugggugcaauacuucuaucaggaggccgcgccugcucagucugacguggcccuccugcgguuuguuaaucccgauaccgggagaguccuuuucgaguguaagcugcauaaaagcggauacgugacaguggcccacaccggccagcaugaccucgucaucccgccuaacggguauuuucgcuucgauuccugggugaaccaauucuacacgcuggcucccaugggcaauggaaccggccggagacgcuga

SEQ ID NO: 29746 - RNA, 1617 nt, Artificial Sequence
  derived and/or modified sequence opt5 from VP1__Norovirus_and/or_Norovirus-like__JX459608
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagacacccgccccucuugggacgcccgauuucgugggaaaaauucagggcguccugacccagacaaccaagggggacggaucuacacggggccacaaggcuaccguguacacgggguccgccccguuuacaccuaaacucggaagcguucaguucuccaccgacaccgaaaacgauuuugagacacaucaaaauaccaaguucacacccgugggcgucauccaggacggcgggacgacccaccgcaacgaaccccagcaaugggugcugccuucuuacagcggaagaaauguucacaacgugcaucuugccccggcugucgcccccacauuuccuggcgagcagcuccuguucuuucgguccaccaugcccggguguagcggauauccuaauauggaucuggacugccugcucccccaggagugggugcagcacuucuaccaagaagcggcuccugcccagucugauguggcccugcuucgcuuuguuaaccccgacacaggcagaguccuguucgaguguaaacuccauaaguccggguaugugaccguggcucacacgggccagcacgaucuggucauuccgccuaacggauacuuucgguucgacagcugggugaaucaguucuauacccuugcccccaugggcaacgggacaggaagacgccgguga

SEQ ID NO: 29747 - RNA, 1617 nt, Artificial Sequence
  derived and/or modified sequence opt5 from VP1__Norovirus_and/or_Norovirus-like__JQ320073
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaguuauuuucgcggccgugccucccaacuuuccuaccgagggacugagccccucccaggucacaauguucccgcauaucgugguggacgucagacaacucgagccuguucugaucccccugccugaugugcggaauaacuuuuaucacuacaaucagucuaacgaccccaccauuaagcucaucgcuaugcuguauacaccccuucgcgccaacaaugcuggcgaagauguguucaccgucagcugcagagugcugacacggccuuccccggacuuugauuucauuuuucucguucccccuaccguggagagccgcacgaaacccuucaccgucccuauccugacaguggaagagaugaccaacucuagauuucccauuccgcuugagaagcuguucacagggccuuccggagccuucguugugcagccccagaauggccgguguaccacggacgggguccuccugggaacaacccaacugagcccugugaacaucugcacauuucgcggcgaugucacccauauugccggcacccacaauuacacaaugaaccucgcuucucagaauuggaacaauuaugaccccacggaagagaucccugcgccccuggggaccccggauuucgugggaagaauccagggcaugcuuacacagaccacacgcggggacggauccacccggggccauaaagccacgguuagcacaggggacgugcacuuuaccccuaagcugggaucuauucaauucaacaccgauacaaauaacgacuuugaaaccggccagaauacaaaguucacgcccgucggcgugguucaggaugggaacggaacccaccaaaaugagccccagcagugggugcucccuuccuacagcggcagaacagggcauaacguccaccuggcuccggccguggcccccaccuuuccuggagaacagcuucuguucuuucgguccacaaugcccggcuguucuggguacccuaacaugaaucucgacugccugcugccccaagagugggugcagcauuucuaucaggaggcugccccugcgcagagcgauguugcucuccugcgcuuugucaaccccgacaccggcagagugcuuuucgaauguaaacugcacaaguccggauacgugacggucgcccacaccggccaacaugaucucgugaucccgccuaauggguauuuucgguucgacagcuggguuaaccaguucuacacacuggcccccaugggaaauggcaccgggagacgccgguga

SEQ ID NO: 29748 - RNA, 1617 nt, Artificial Sequence
  derived and/or modified sequence opt5 from VP1__Norovirus_and/or_Norovirus-like__HM802552
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggggucuguucaauucgccaccgacacagauaacgacuuugagaccggacagaauacaagauucacgcccgugggcgucauucaggauggcagcuccacccaucggaacgaaccccaacagugggugcucccugacuacagcgggcgcacaguucacaaugugcaccuggcuccggccgucgcccccaccuuuccuggagagcagcuucuguucuuuagaucuacaaugcccggcuguuccggguacccuaacauggaucucgacugccugcugccccaggaaugggugcaacauuucuaucaggaggcugccccuagccagucugauguggcgcuccugcgguuuguuaaucccgacaccggaagaguccuuuucgaguguaagcugcacaaagcuggcuacgugacgguggcccauaccgggcagcacgaucucgucaucccgccuaacggcuauuuucgcuucgacagcugggugaaucaauucuacacacuggcccccaugggaaacggcgcugggcggagacgcuga

SEQ ID NO: 29749 - RNA, 1617 nt, Artificial Sequence
  derived and/or modified sequence opt5 from VP1__Norovirus_and/or_Norovirus-like__AB541320
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgccucucgcacgaaacccuucuccguuccuagcgugaccgucgaagagaugacaaauucuagauuucccaucccgcuggaaaaacuuuucaccgggccuuccagcgccuucgugguucagccccagaacggacgguguacaaccgauggcgugcugcucgggacgacacaacugucuccugucaauauuugcaccuuucgcggagacgugacacauaucaccggcuccagaaacuacaccaugaaucuggcuacacagaacuggaauagcuaugaucccacggaggagaucccugcgccccucggcaccccggacuucgucgggaagauucagggagugcugacacagaccacacgggccgacggcuccacccgcgggcacaaggcuacgguuuacacaggaucugccgauuuugccccuaaacuuggcagagugcaauucgcuaccgacaccgauaacgacuuugaugccaaucagaacacaaaguucacccccgucggggugauccaggacggagauacagcgcaucggaaugaaccccaacaguggguucugccuagcuacuccggccgcaacagccacaaugugcaccucgcuccgacggucgcccccaccuuuccuggcgagcagcugcuuuucuuuagaucuacaaugcccggguguuccggauauccuaacauggaccuggauugccuccugccccaggaaugggugcaauacuucuaucaggaggccgcuccugcccagagcgacguggcucugcuccgguuuguuaaucccgauaccggcagaguccuguucgaauguaaacuucauaagucuggguacgugacaguggcccacaccggacagcaugaccuggucauuccgccuaacggcuauuuucgcuucgacagcugggugaaccaauucuacacgcucgcgcccauggggaauggcaccggacggagacgcuga

SEQ ID NO: 29750 - RNA, 1617 nt, Artificial Sequence
  derived and/or modified sequence opt5 from VP1__Norovirus_and/or_Norovirus-like__AB541227
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugagacccaucaaaacacaaaguucacccccgugggcgucauucaggacggcgggacaacgcaccgcaaugaaccccagcaaugggugcugccuagcuacuccggaagagauguucacaacgugcaucuugccccggcugucgcccccaccuuuccuggcgagcagcuccuguucuuucggagcacaaugcccggguguucuggauauccuaauauggaccuggauugccugcucccccaggagugggugcagcacuucuaccaagaagcggcuccugcccaguccgacguggcccugcuucgcuuuguuaaccccgauaccggcagaguccuguucgaguguaaacuccauaagagcggguaugugacaguggcucacaccggccagcacgaccuggucaucccgccuaauggauacuuucgguucgauucuugggugaaccaguucuauacgcuugcccccaugggcaacgggaccggaagacgccgguga

SEQ ID NO: 29751 - RNA, 1617 nt, Artificial Sequence
  derived and/or modified sequence opt5 from VP1__Norovirus_and/or_Norovirus-like__AB504318
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggccugcucacgcagaccacaaagggggacggaucuacccggggccacaaggcuacagucuacaccggguccgccccguuuacgccuaaacugggaggcgugcaguucagcacagacaccgaaaacgauuuugagacccaucaaaauacaaaguucacccccguuggcgugauucaggacggguccacaacgcaccgcaacgaaccccagcaauggguccuuccuucuuacagcggaagaaaugugcacaacguucaucuggccccggcuguggcccccaccuuuccuggcgagcagcuccuguucuuucgguccacaaugcccggguguagcggauauccuaauauggaucuggacugccuccugccccaggaguggguccagcacuucuaccaagaagcggcuccugcccagucugauguggcccuucugcgcuuugugaaccccgacaccggcagaguucucuucgaguguaaacugcauaaguccggguaugucacaguggcucacaccggccagcacgaucuugugaucccgccuaacggauacuuucgguucgacagcugggucaaucaguucuauacgcuggcccccaugggcaacgggaccggaagacgccgguga

SEQ ID NO: 29752 - RNA, 1617 nt, Artificial Sequence
  derived and/or modified sequence opt5 from VP1__Norovirus_and/or_Norovirus-like__AB504311
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcaccuauaauggguacgcuggaggcuucgaaguccaggugauccuugccggcaacgcuuuuacagccgggaaaauuaucuucgcggccguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgcuaugcuguauacaccccuucgcgccaacaacgcuggcgaugacguuuucaccguguccugcagagugcugacgcggcccagcccugauuuugacuucauuuuucucgucccgcccaccguggaaucucgcacaaaaccuuucuccguucccauccugaccguggaggaaaugacaaauagcagauuuccuauuccccuugagaagcuguucaccgggccgucuuccgccuucgucgugcagccucagaacggacgguguacgacagauggcguucuccuggggaccacacaacugagccccgugaauaucugcaccuuucgcggagacgucacccauaucgccggcacacagaacuacacgaugaaucucgcuucucagaacuggaauaacuaugauccuaccgaggaaauucccgcgccucugggcacacccgacuucguggggaaaauccagggaguccuuacccaaacaaccagacgggacggcuccacgcgcgggcacaaggccacagugagcaccggauccguucauuuuaccccgaagcugggcucugugcaguucagcacagauaccuccaaugacuuugagacagggcagaacacgagauucaccccugucggagugguucaagauggcagcacaacccaccagaaugaaccccagcagugggugcuccccaacuacucuggccgggacucccacaauguccaucuggcuccugccguggccccgacauuucccggggagcaacuucuguucuuucgcagcaccaugccuggauguucuggcuaccccaacaugaaucucgauugccugcugccucaggaaugggugcagcacuucuaucaggagagcgcucccgcccaauccgacguugcgcuccugagauuugucaacccugauacggggcgggugcuuuucgaguguaaacugcauaagucuggauacgugaccgucgcucacacaggccagcacgaccucgugauucccccgaacggguauuuuagauucgauagcuggguuaaucaguucuacacccuggccccuaugggcaacggagccggccgccggagauga

SEQ ID NO: 29753 - RNA, 1617 nt, Artificial Sequence
  derived and/or modified sequence opt5 from VP1__Norovirus_and/or_Norovirus-like__FJ537135
augaagauggccagcuccgacgcuaaccccucugauggcagcaccgccaaucuggugccugaggucaacaaugaaguuauggcgcucgagccgguggugggggcugccaucgccgcucccgucgccggacagcaaaacaucaucgacccuuggauuagaaauaacuucgugcaggcucccggcggggaauuuacaguuuccccucggaaugcccccggagagauccuguggucugcgccucuuagcccggaucugaaccccuaccucucccaccugucucgcauguauaauggcuacgccgggggauucgaagugcaggucauucuugcuggcaacgccuuuacggcuggcaaaaucaucuucgccgcgauuccucccaauuuuccuaccgaggggcugagccccucccaggugacaauguucccgcauaucauuguugacgugagacaacucgagccuguccugaucccccugccugaugugcggaacaauuuuuaucacuacaaccaggcccaugacagcacccucaagcugauugcuaugcuuuauacaccccugcgcgccaauaacgcuggagaugacguguucaccgucucuugcagaguucucacacggcccuccccugauuuugacuucaucuuucuggugccgcccaccguggaaagccgcacgaaaccuuucaccguccccauucuuacaguggaggaaaugucuaacuccagauuuccuaucccccuggagaagcucuacaccggcccgagcucugccuucguugugcagccucagaaugggcgguguacaaccgauggaguccugcugggcacgacacaacucuccgccgugaacaucugcaauuuccgcggggacguuaccagagugggaauuagccacgauuauacaaugaaccuggucucccagaauuggaacaauuacgaccccaccgaggaaaucccugcuccccuuggcaccccugacuuugugggcaaaauucaggggcugcucacacagacgacccgggcggauggaucuacacgcgcccauaaggcuaccgucagcacaggcuccgugcacuucacccccaagcuggggagcguucaauuuacgacagacaccaacaaugauuuccagaccggacagaacacaaaauuuaccccggugggcgucauccaagacggggaucaccaucagaaugagccucagcagugggugcuucccaacuacucuggaacauccggccacaauguucaucuggcccccgccguggcuccuacguucccgggcgaacaacuccuguuuuucagaagcaccaugcccggguguucuggauauccuaacaugaaucuggacugccuccugccccaggagugggucagccacuuuuaccaggaagccgcgccugcucaguccgauguggcccuucugcgguucgugaaccccgacacaggccgcguucucuuugaguguaagcugcacaaaucuggguauauuaccgucgcccauacaggaccuuacgaucuugugauucccccgaacggcuauuucagauuugacagcugggugaaucaauucuacacccuggcuccuauggggaacggcuccggacggaagagagucuga

SEQ ID NO: 29754 - RNA, 1617 nt, Artificial Sequence
  derived and/or modified sequence opt5 from VP1__Norovirus_and/or_Norovirus-like__GQ413969
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggucuaacuacgauccuacagaggaaauucccgccccucugggcacgcccgacuuuguggggaagauccagggaaugcuuacccagacaaccggccgcgacggguccacaagaggacacaaagcuaccguccugacgggcagcgccgauuucgccccgaagcucgggcgggugcaauuugcuacagacaccgauaaugacuucgaguccggagaaaacaccaaguuuacaccuguuggcgugauucaggauggcucuaccacacaucgcaaugagccccagcaauggguccugcccaacuacagcgggagaacgggacacaaugugcaccuugccccugcgguugcuccgaccuaucccggcgaacagcuccuguucuuucgguccacaaugccuggguguagcggauaccccaacauggaccuggauugccugcucccucaggagugggugagacauuucuaucaggaggccgcccccgcucaaucugacgucgcccugcuucgcuuugugaauccugauaccggccgggugcuguucgaauguaaacuccacaagcccggguacguuacagucgcucauaccggccagcacgaccuggugaucccgccuaacggauauuuuagauucgauuccugggugaaccaguuuuacacgcuugcccccaugggcaaugggaccggacgccggagauga

SEQ ID NO: 29755 - RNA, 1617 nt, Artificial Sequence
  derived and/or modified sequence opt5 from VP1__Norovirus_and/or_Norovirus-like__EU839592
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacagccuacaccggcagcgccccguuuacgccuaaacucggguccgugcaguucucuacagacaccgaaaacgauuuugagacccaucaaaauacaaaguucgcucccguuggagugauucaggacggcggcaccacacaccgcaacgaaccccagcaauggguccugccuagcuacuccgggagaaaugugccgaacguucaccuugcccccgcgguggcuccuacguuucccggagagcagcuccuguucuuucggagcaccaugccuggcuguucuggguaucccaauauggaucuggacugccugcucccucaggaguggguccagcauuucuaccaagaagccgcccccgcucaguccgauguggcccugcuucgcuuugugaacccggacacaggaagaguucuguucgaguguaaacuccacaagagcggcuaugucaccguggcucauacagggcagcacgaucuggugaucccucccaacggcuacuuucgguucgacucuugggucaaucaguucuauacccuugccccuaugggaaacggcacggggagacgccgguga

SEQ ID NO: 29756 - RNA, 1617 nt, Artificial Sequence
  derived and/or modified sequence opt5 from VP1__Norovirus_and/or_Norovirus-like__EU839587
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagagccuaccggaugaaccucgcuucucagaauuggaacaauuaugaucccacagaggaaauuccugcgccccugggcacgccggacuucguggggaaaauccagggaaugcuuacccagacaaccaagggcgacggguccacacgcggacacaaggccaccgucagcacgggcuccguggauuuuacaccuaaacuggggucuguucaauucgcuaccgacaccgauaacgacuuugagacaggacagaauaccagauucacacccgugggcgucauucaggauggcagcuccacgcaucggaacgaaccccaacagugggugcucccugacuacagcgggcgcaccguucacaaugugcaccuggccccggccgucgcucccacauuuccuggagagcagcuucuguucuuuagaucuaccaugcccggcuguuccggguacccuaacauggaucucgacugccugcugccccaggaaugggugcaacauuucuaucaggaggccgcgccuagccagucugauguggcucuccugcgguuuguuaaucccgacacaggaagaguccuuuucgaguguaagcugcacaaagccggcuacgugaccguggcccauacggggcagcacgaucucgucaucccgccuaacggcuauuuucgcuucgacagcugggugaaucaauucuacacccuggcucccaugggaaacggcgccgggcggagacgcuga

SEQ ID NO: 29757 - RNA, 1617 nt, Artificial Sequence
  derived and/or modified sequence opt5 from VP1__Norovirus_and/or_Norovirus-like__EU839583
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggggucuguucaauucgccaccgacacagauaacgacuuugagaccggacagaauacaagauucacgcccgugggcgucauucaggauggcagcuccgcucaucggaacgaaccccaacagugggugcucccugacuacagcgggcgcaccguucacaaugugcaccuggccccggccgucgcucccacauuuccuggagagcagcuucuguucuuuagaucuaccaugcccggcuguuccggguacccuaacauggaucucgacugccugcugccccaggaaugggugcaacauuucuaucaggaggccgcgccuagccagucugauguggcucuccugcgguuuguuaaucccgacacaggaagaguccuuuucgaguguaagcugcacaaagccggcuacgugaccguggcccauacggggcagcacgaucucgucaucccgccuaacggcuauuuucgcuucgacagcugggugaaucaauucuacacccuggcucccaugggaaacggcgccgggcggagacgcuga

SEQ ID NO: 29758 - RNA, 1617 nt, Artificial Sequence
  derived and/or modified sequence opt5 from VP1__Norovirus_and/or_Norovirus-like__AB303931
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcacccacaauuacaccaugaaccucgcgucccagaauuggaacaauuaugacccuacagaagagauucccgccccucuggggacgcccgauuucgugggaagaauccagggcaugcuuacccagacaacccgcggggacggaagcacacggggccauaaagcuaccgucucuacgggggacgugcacuuuacaccgaagcugggauccauucaauucaacaccgauaccaauaacgacuuugaaacaggccagaauaccaaguucacaccuguuggcgugguccaggaugggaacggagcccaccaaaaugagccccagcagugggugcuccccagcuacuccggcagaacggggcauaacguucaccuggccccugcuguggccccgaccuuucccggagaacagcuucuguucuuucggucuacaaugccuggcuguagcggguaccccaacaugaaucucgacugccugcugccucaagaguggguccagcauuucuaucaggaggcggcucccgcccaguccgauguggcccuccugcgcuuugugaacccugacaccggcagaguucuuuucgaauguaaacugcacaagagcggauacgucacaguggcucacaccggccaacaugaucucgugauucccccgaauggguauuuucgguucgacucuugggucaaccaguucuacacgcuggccccuaugggaaauggcaccgggagacgccgguga

SEQ ID NO: 29759 - RNA, 1617 nt, Artificial Sequence
  derived and/or modified sequence opt5 from VP1__Norovirus_and/or_Norovirus-like__KY341923
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccuuuccuguccugacgguggaggaaaugaccaauagcagauuccccaucccgcuugagaagcuguucacagggccuucuuccgccuuuguugugcagccccagaacggacgguguaccacagauggcguccuccuggggaccacgcaacugagcccugugaauauuugcacauuccgcggagacgucacccauaucacaggcucuagaaacuacaccaugaaucucgcuucccagaacuggaauaacuaugaucccaccgaggaaauuccugcgccccugggcacaccggacuuuguggggaaaauccagggaguucuuacgcagaccacacggaccgacggcagcacacgcgggcacaaggccaccguguacacgggauccgcugauuucgccccuaagcugggcagaguccaauuugagacagacaccgaucaugacuucgaagccaaucagaacaccaaauuuacacccguggggguuauccaggauggaucuaccacacaccggaaugagccccaacagugggugcucccuagcuacuccggccgcaacacgccgaauguccaccuggcucccgccguggcgccuaccuuccccggcgaacagcuucuguuuuucagaagcacaaugccuggguguucuggauaucccaacauggaccucgauugccugcugccucaggagugggugcaauacuuuuaucaggaggcugcccccgcccaguccgacguugcucuccugcgguucgucaauccggauaccggcagagugcuuuuugaauguaagcugcauaaaagcggguacgugacagucgcccacaccggacagcaugaccucgugauuccucccaacggcuauuuccgcuucgauucuuggguuaaccaauuuuacacgcuggcuccuauggggaauggcaccggacggagacgcuga

SEQ ID NO: 29760 - RNA, 1617 nt, Artificial Sequence
  derived and/or modified sequence opt5 from VP1__Norovirus_and/or_Norovirus-like__KX514317
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaacgcuggcgaugacguuuucaccgugagcugcagagugcugacccggcccucuccugauuuugacuucauuuuucucgucccgcccacgguggaaucccgcagcaaaccuuucucuguucccgugcugaccgucgaggaaaugacaaacuccagauuuccugccacccuugauaagcuguucacagggcccagcucuaccuucgugguucagccgcagaauggacgguguacgaucgacggcgagcuccuggggacaacccaacuguccagcgugaacauuugcacauuucgcggagaugucacccauccuagagacuccaaaaucuacaccaugaaucucgccucucccaacuggaauaacuaugacccuacagaggaaauccccgcuccucugggcacgcccgauuucgugggcaagauucaggggaugcuuacccagacaaccaagggagagggcagcacacgggggcaccgcgcgaccgucuacgugggauccgccaauuacgcuccgaaacugggcagaguucaguuugaaacggacacaaccgaugaccucgaugcccaucaaaacaccaaguucacaccugugggggucgugcagggaggcgagagccccaaaggcucugaaccccagcaauggguucugccuaauuauuccggggccaacaccuuuaaugugcaccuugcuccggccgucgcgcccaacuucccuggagagcagcugcucuuuuuccggagcacacugcccggcugugggggacacccuaauauggaccuggauugccuccugccccaggagugggugcagcauuuuuaccaagaagcugccccugcccagucugacguggcccuucugcgcuucguuaaccccgauacgagcagaguccucuuugaguguaagcugcacaaauccggcuaugugaccguggcucauacagggcaguacgaccuuguccugccgucuaauggcuauuuccgguuugauagcugggugaaccaguucuacacccucgcuccuaugggaaacggcacagggagacgccgguga

SEQ ID NO: 29761 - RNA, 1617 nt, Artificial Sequence
  derived and/or modified sequence opt5 from VP1__Norovirus_and/or_Norovirus-like__KU678204
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagauccaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggaaugcuuacgcagaccacacggaccgacggcucuacacgcgggcacaaggccaccguguacacgggaagcgcugauuuugccccuaagcugggcagaguccaauucgagacagacaccgaucaugacuuugaagccaaucagaacaccaaauucacacccguggggguuauccaggauggauccaccacacaccggaaugagccccaacagugggugcucccuagcuacucuggccgcaacacgccgaauguccaccuggcucccgccguggcgccuaccuuucccggcgaacagcuucuguucuuuagauccacaaugccuggguguagcggauaucccaacauggaccucgauugccugcugccucaggagugggugcaauacuucuaucaggaggcugcccccgcccagucugacguugcucuccugcgguuugucaauccggauaccggcagagugcuuuucgaauguaagcugcauaaaagcggguacgugacagucgcccacaccggacagcaugaccucgugauuccucccaacggcuauuuucgcuucgauuccuggguuaaucaauucuacacgcuggcuccuauggggaacggcaccggacggagacgcuga

SEQ ID NO: 29762 - RNA, 1617 nt, Artificial Sequence
  derived and/or modified sequence opt5 from VP1__Norovirus_and/or_Norovirus-like__KX158283
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagacuucccaucccgcuggagcggcucuuuacagggccuucuuccgccuucgugguccagccccagaacggacgcuguaccacagauggcgugcugcuggggaccacgcaacucagcccugucaauauuugcacauucagaggagacgugacccauaucacaggcucucacaacuacaccaugaaucuggcuucccagaacuggaauaacuaugaucccaccgaggaaauuccugcgccccuuggcacaccggacuuuguugggaagauccagggagugcugacgcagaccacacggaccgacggcagcacacgcgggcauaaagccaccgucuacacgggauccgcugaguucgccccuaagcucggcagagugcaauuugaaacagauaccaaucacgacuucgaggccaaccagaauaccaaguuuacacccguuggggugauccaggauggaucuaccacacaccggaacgaaccccaacaguggguccugccuagcuacuccggccgcaauacgcauaacgugcaccuugcuccggccguggcgcccaccuucccuggcgagcagcugcucuuuuucagaagcacaaugcccggguguucuggauauccuaauauggaccuggauugccugcucccccaggaguggguucaauacuuuuaucaggaagcugccccugcccaguccgacgucgcucugcuucgguucgugaaccccgauaccggcagagugcuguuugaguguaaacuccauaagagcggguacauuacagucgcccacaccggacagcacgaccuggugaucccgccuaacggcuauuuccgcuuugauucuuggguuaaucaauucuacacgcuugcucccauggggaacggcaccggacggagacgcuga

SEQ ID NO: 29763 - RNA, 1617 nt, Artificial Sequence
  derived and/or modified sequence opt5 from VP1__Norovirus_and/or_Norovirus-like__KX354088
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaacuguucacgguuccuauccuuaccguggaggaaaugacaaacuccagauuucccauuccucuggagaaacucuucaccgggcccagcucugccuucgucgugcagccgcagaauggacgguguacaaccgauggcguucugcuggggacgacacaacucuccccugugaacaucugcaccuuucgcggagacgucacacauaucgcuggcagcagaaauuacaccaugaaccuggcgucucuuaauuggaacaauuaugaucccaccgaggaaauuccugcuccccugggcacaccugacuucguggggaagauccagggaguccucacgcagaccacaaagggcgacggguccacccggggacacaaggcuacaguguacaccggcagcgccgauuuuacgcccaaacugggguccguucaguucgccacagacaccgagaacgauuuugaaacccaucaaaauacacgcuucaccccggugggagucauucaggacggcggcacaacgcacagaaacgagccucagcaaugggugcuucccucuuacagcgggcggaauguucacaacgugcaucuggcucccgccgucgcgccuaauuuuccgggagaacagcuccuguucuuucgcuccaccaugcccggcuguagcggguauccuaacauggaucuggacugccuccugccccaggagugggugcagcacuucuaccaagaggcugccccugcccagucugauguggcccuucugagauuuguuaaccccgacacaggacggguccucuucgaauguaagcugcauaaauccggcuaugugaccguggcccacacagggcaguacgaucuugucaucccucccaauggcuauuuuagauucgacagcugggugaaccaguucuacacccuggcuccgaugggaaauggcacggggcgccggagauga

SEQ ID NO: 29764 - RNA, 1617 nt, Artificial Sequence
  derived and/or modified sequence opt5 from VP1__Norovirus_and/or_Norovirus-like__KX354032
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgugggcgaugacgucuucaccgugagcugcagaguucugacccggccuucuccggauuuugacuucauuuuucucgugcccccuacagucgaaucccgcaccaaacccuucagcgugccuguucugacgguggaggaaaugaccaacucuagauuucccaucccgcuugagaagcuguucacagggccuuccagcgccuucgucgugcagccccagaauggacgguguaccacagauggcguccuccuggggaccacgcaacugucuccugugaacauuugcacauuucgcggagacguuacccauaucacaggcuccagaaauuacaccaugaaccucgccagccagaauuggaacaauuaugaucccaccgaggaaauuccugcuccccugggcacaccggacuucguggggaaaauccagggaguccuuacgcagaccacacggaccgacggcuccacacgcgggcacaaggcgaccguguacacgggaucugccgauuuugcuccuaagcugggcagaguucaauucgagacagacaccgaucaugacuuugaagccaaccagaauaccaaauucacacccgugggggucauccaggauggaagcaccacacaccggaacgagccccaacagugggugcucccuuccuacagcggccgcaauacgcacaacgugcaucuggccccggcuguugcccccaccuuuccuggcgaacagcuucuguucuuuagaucuacaaugcccggguguuccggauauccuaauauggaccucgauugccugcugccccaggaguggguccaauacuucuaucaggaggcggcuccugcccagagcgacguggcccuccugcgguuugugaaccccgauaccggcagaguccuuuucgaauguaagcugcacaaaucuggguacgugacaguugcucauaccggacagcacgaccucgugauuccgccuaauggcuauuuucgcuucgauagcugggucaaccaauucuacacgcuggcccccauggggaacggcgcuggacggagacgcuga

SEQ ID NO: 29765 - RNA, 1617 nt, Artificial Sequence
  derived and/or modified sequence opt5 from VP1__Norovirus_and/or_Norovirus-like__KX354015
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauuggaacaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccacacaccggaacgagccccaacaguggguccucccuuccuacagcggccgcaauacgcacaacgugcaucuggcuccggccguggcgcccaccuuuccuggcgaacagcuucuguucuuuagaucuacaaugcccggguguuccggauauccuaauauggaccucgauugccugcugccccaggacuggguucaauacuucuaucaggaggcugccccugcccagagcgaugucgcucuccugcgguuugugaaccccgacaccggcagagugcuuuucgaguguaagcugcacaaaucuggguacgucacaguggcccauaccggacagcacgaucucguuauuccgccuaauggcuauuuucgcuucgacagcugggugaaccaauucuacacgcuggcucccauggggaacggcgccggacggagacgcuga

SEQ ID NO: 29766 - RNA, 1617 nt, Artificial Sequence
  derived and/or modified sequence opt5 from VP1__Norovirus_and/or_Norovirus-like__KX353999
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucucuggcuccagaaacuacaccaugaaucucgccagccagaacuggaacuccuaugaucccaccgaggaaauuccugcuccccugggcacaccggacuucguggggaaaauccagggaguccuuacgcagaccacaucuaccgacggcagcacacgggggcacaaggcgaccguguacacgggauccgccgauuuuagcccuaagcugggccgcguucaauucgcuacagacaccgauaaugacuuugagaccaaucagaacacaaaauucacccccgugggggucauucaggauggaggcacaacgcauagaaaugaaccccaacagugggugcucccuucuuacuccggccggaacauccacaauguucaccuggccccggccguggcucccaccuuuccuggggagcagcuucuguucuuucgcagcacaaugcccggauguucuggcuauccuaacauggaccucgauugccugcugccccaggaauggguccaauacuucuaucaggaggccgcgccugcucagagcgacguggcccuccugagauuugugaaucccgauaccgggcggguucuuuucgaguguaagcugcauaaauccggauacgucacaguggcccacaccggccagcaugaccucgugauuccgccuaacggguauuuuagauucgauucuugggucaaccaauucuacacgcuggcucccaugggcaauggaaccggccgccggagauga

SEQ ID NO: 29767 - RNA, 1617 nt, Artificial Sequence
  derived and/or modified sequence opt5 from VP1__Norovirus_and/or_Norovirus-like__KX353987
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgacagcaccauuaagcucaucgcuaugcuguauacaccccuucgcgccaauaacgcuggcgaugacguuuucaccgugucuugcagagugcugacacggcccuccccugauuuugacuucauuuuucucgucccgcccaccguggaaagccgcacgaaaccuuucucuguucccgugcugaccgucgaggaaaugacaaacuccagauuuccuaucccccuugagaagcuguucaccgggccgagcucugccuucgugguucagccucagaauggacgguguacaaccgauggcgugcuccuggggacgacacaacugucccccgucaacauuugcaccuuucgcggagacgugacacauaucagcggcucccacaauuacaccaugaaccucgccucucagaauuggaacagcuaugauccuaccgaggaaauccccgcuccucugggcacacccgacuucgucgggaaaauucagggagugcuuacgcagaccacaaagaccaauggcuccacaagagggcauaaggcgaccguuuacacgggaagcgccgacuuuucuccgaaacugggccgggugcaauucgcuacagauaccgacaacgauuuugagaccaaucagaacacaaaguucaccccugucggggugauccaggacggauccacaacgccccgcaaugaaccccaacaguggguucucccuagcuacucuggcagaaacacccacaaugugcaccuggccccggccgucgcucccacauuuccuggcgagcagcuucuguucuuucggagcaccaugcccggguguuccggauauccuaacauggaucucgacugccugcugccccaggaaugggugcaauacuucuaucaggaggccgcgccugcucagucugauguggcccuccugcgcuuuguuaaucccgacacaggcagaguccuuuucgaguguaaacugcauaagagcggguacgugaccguggcccacacgggacagcaugaucucgucauuccgccuaacggcuauuuucgguucgacuccugggugaaccaauucuacacccuggcucccauggggaauggcacaggaagacgccgguga

SEQ ID NO: 29768 - RNA, 1617 nt, Artificial Sequence
  derived and/or modified sequence opt5 from VP1__Norovirus_and/or_Norovirus-like__KX353970
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauacccauaacgugcaccuggcccccgccgucgcuccuacauuucccggcgagcagcuucuguucuuuagaagcaccaugccuggguguucuggauaucccaauauggaucucgacugccugcugccucaggaaugggugcaauacuucuaucaggaggccgcgcccgcucagagcgauguggcccuccugcgguuuguuaacccggacacaggcagaguccuuuucgaguguaagcugcacaaauccggguacgugaccguggcccauacgggacaguaugaucucgucauuccucccaacggcuacuuucgcuucgacucuugggugaaucaauucuauacccuggcuccuauggggaacggcacaggacggagacgcuga

SEQ ID NO: 29769 - RNA, 1617 nt, Artificial Sequence
  derived and/or modified sequence opt5 from VP1__Norovirus_and/or_Norovirus-like__KU985156
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggaggcugccccugcccagucugacgucgcucuccugcgguuugugaaucccgauaccgggagagugcuuuucgaauguaagcugcacaaauccggauacgucacaguggcccauaccggccagcacgaccucguuauuccgccuaacggguauuuucgcuucgauagcugggugaaccaauucuacacgcuggcucccaugggcaauggaaccggccggagacgcuga

SEQ ID NO: 29770 - RNA, 1617 nt, Artificial Sequence
  derived and/or modified sequence opt5 from VP1__Norovirus_and/or_Norovirus-like__KU985155
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaaguuaaucagaacaccaaauucacacccgugggggucauccaggauggaggcaccacacaccggaaugagccccaacagugggugcucccuucuuacagcggccgcaacacgcacaaugugcaucuggccccggcuguugcccccaccuuuccuggggaacagcuucuguucuuuagauccacaaugcccggauguagcggcuauccuaacauggaccucgauugccugcugccccaggaguggguccaauacuucuaucaggaggcggcuccugcccagucugacguggcccuccugcgguuugugaaucccgauaccgggagaguccuuuucgaauguaagcugcacaaaccgggauacgugacaguugcucauaccggccagcacgaccucgugauuccucccaacggguauuuucgcuucgauuccugggucaaccaauucuacacgcuggccccuaugggcaauggaaccggccggagacgcuga

SEQ ID NO: 29771 - RNA, 1617 nt, Artificial Sequence
  derived and/or modified sequence opt5 from VP1__Norovirus_and/or_Norovirus-like__KM514075
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccgauagagacuuugaagccaaccagaauaccaaauucacacccguuggggugauccaggauggaggcaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggaccucgauugccugcugccucaggaguggguucaauacuucuaucaggaggcugcccccgcccaguccgacgucgcucuccugcgguuugugaacccggauaccgggagagugcuuuucgaauguaagcugcauaaaagcggauacgucacaguggcccacaccggccagcaugaccucguuauuccucccaauggguauuuucgcuucgauucuugggugaaccaauucuacacgcuggcuccuaugggcaacggaaccggccggagacgcuga

SEQ ID NO: 29772 - RNA, 1617 nt, Artificial Sequence
  derived and/or modified sequence opt5 from VP1__Norovirus_and/or_Norovirus-like__AB972484
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcgacacgcacaacgugcaucuggcuccggccguggcgcccaccuuuccuggggaacagcuucuguucuuuagauccacaaugcccggauguagcggcuauccuaauauggaucucgacugccugcugccccaggaguggguucaauacuucuaucaggaggcugccccugcccagucugaugucgcucuccugcgguuugugaaccccgacaccgggagagugcuuuucgaauguaagcugcacaaauccggauacgucacaguggcccauaccggccagcacgaucucguuauuccgccuaauggguauuuucgcuucgacagcugggugaaccaauucuacacgcuggcucccaugggcaacggaaccggccggagacgcuga

SEQ ID NO: 29773 - RNA, 1617 nt, Artificial Sequence
  derived and/or modified sequence opt5 from VP1__Norovirus_and/or_Norovirus-like__KT780391
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuuucuccuaagcugggcagagugcaauucgagacagacaccgaucaugacuuugaagccaaucagaacaccaaauucacacccguuggggugauccaggauggaggcaccacacaccggaaugagccccaacaguggguccucccuagcuacuccggccgcaacacgccgaaugugcaccuggcccccgcuguggccccuaccuuucccggggaacagcuucuguucuuuagaagcacaaugccuggauguucuggcuaucccaacauggaccucgauugccugcugccucaggaguggguucaauacuucuaucaggaggcggcucccgcccaguccgacgucgcccuccugcgguuugugaauccggauaccgggagagugcuuuucgaauguaagcugcauaaaagcggauacgucacaguggcucacaccggccagcaugaccucguuauuccucccaacggguauuuucgcuucgauucuugggugaaccaauucuacacgcuggccccuaugggcaauggaaccggccggagacgcuga

SEQ ID NO: 29774 - RNA, 1617 nt, Artificial Sequence
  derived and/or modified sequence opt5 from VP1__Norovirus_and/or_Norovirus-like__KT780390
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauacaaccggcucucacaacuacaccaugaaucucgcuucccagaacuggagcaauuaugaucccacagaggaaaucccugcgccccugggcacgccggacuucguugggaaaauucagggagugcuuacccagacaaccagaacagacggcuccacccgggggcauaaggccacggucuacacaggaucugcugauuuugccccuaagcugggccgcgugcaauucgagaccgacaccgaucacgaccucgaagccaaccagaauacaaaauuuacccccguuggggugauccaggauggaggcgcuacacacagaaacgagccccaacaguggguccugccuagcuacuccggccggaauacgccgaacgugcaucuugcccccgcgguggcuccuaccuuccccggggaacagcugcucuuuuuccgcagcacaaugccuggauguucuggcuaucccaauauggaccuggauugccugcucccucaggaguggguucaauacuuuuaucaggaggccgcccccgcucaguccgacgucgcccugcuuagauucgugaacccggauaccgggcgggugcuguuugaauguaagcuccacaaaagcggauacgucacaguggcucauaccggccagcacgaccugguuaucccucccaauggguauuucagauuugauucuugggugaaccaauucuacacgcuugccccuaugggcaacggaaccggccgccggagauga

SEQ ID NO: 29775 - RNA, 1617 nt, Artificial Sequence
  derived and/or modified sequence opt5 from VP1__Norovirus_and/or_Norovirus-like__KT780376
augaagauggccagcuccgacgcuaaccccucugauggcagcgccgcgaaucuggugccugaggucaacaaugaaguucucgcucuggagccgguggugggggccgccaucgcugcccccgucgcuggacagcaaaacgugauugacccuuggaucagaaauaacuucguucaggcccccggcggggaauuuaccguguccccucggaaugcgcccggagagauucuuuggucugccccucugggcccggaucucaaccccuaccugagccaccuugcucgcauguauaauggguacgccggaggcuucgaaguccaggugauccuggcuggcaacgccuuuacagcggggaaaguuauuuucgccgcugugccucccaauuuuccuacggagggacucucccccucucaggucaccauguucccgcauaucgugguggacgucagacaacuggagccuguucugaucccccucccugaugugcggaacaauuuuuaucacuacaaccagagcaaugaccccacaauuaagcugaucgccaugcuuuauacaccccugcgcgcuaacaacgccggcgaugacguguucaccgucuccugcagagugcucacccggccuagcccggauuuugacuucauuuuucugguucccccuacaguggaaucucgcaccaaacccuucuccgucccugugcuuacgguugaggaaaugaccaauagcagauuucccaucccgcuggagaagcuguucacagggccuucuuccgccuucgugguccagccccagaacggacgguguaccacagauggcgugcugcuggggaccacgcaacucagcccugucaauauuugcacauuucgcggagacgugacccauaucacaggcucucacaacuacaccaugaaucuggcuucccagaacuggagcaauuaugaucccaccgaggaaauuccugcgccccuuggcacaccggacuucguugggaaaauccagggagugcugacgcagaccacaagaaccgacggcuccacacgggggcauaaggccaccgucuacacgggaucugcugauuuugccccuaagcucggccgcgugcaauucgagacagacaccaaccacgauuuugaagccaaucagaacaccaaauucacacccguuggggugauccaggacggaagcaccacacacagaaaugagccccaacaguggguccugccuuccuacagcggccggaacacgccgaaugugcaucuugcucccgccguggcgccuaccuuucccggcgaacagcuccucuucuuucgcucuacaaugccuggguguuccggauaucccaacauggaucuggacugccugcucccucaggaguggguucaauacuucuaucaggaggcugcccccgcccagagcgaugucgcucugcuuagauuugugaauccggacaccggccgggugcuguucgaauguaagcuccacaaaucuggguacgucacaguggcccauaccggacagcacgaucugguuauuccucccaacggcuauuuuagauucgacagcugggugaaccaauucuacacgcuugcuccuauggggaauggcaccggacgccggagauga

SEQ ID NO: 29776 - RNA, 1617 nt, Artificial Sequence
  derived and/or modified sequence opt5 from VP1__Norovirus_and/or_Norovirus-like__KT780375
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccuauccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacauuacccauaucacaggcucuagaaacuacaccaugaaucucgcuucccagaacuggagcaauuaugaucccaccgaggaaaucccugcgccccugggcacaccggacuucgucgggaaaauucagggagugcuuacgcagaccacacggaccgacggcuccacacgcgggcacaaggccaccguuuacacgggaucugcugauuuugccccuaagcugggcagagugcaauucgagacagacaccgaucaugacuuugaagccaaccagaauaccaaauucacacccgucggggugauccaggauggaagcaccacacaccggaacgagccccaacaguggguucucccuuccuacagcggccgcaauacgccgaacgugcaccuggcucccgccgucgcgccuaccuuucccggcgaacagcuucuguucuuuagaucuacaaugccuggguguuccggauaucccaauauggaccucgauugccugcugccucaggagugggugcaauacuucuaucaggaggcugcccccgcccagagcgacguggcucuccugcgguuuguuaacccggauaccggcagaguccuuuucgaauguaagcugcauaaaucuggguacgugacaguggcccacaccggacagcaugaccucgucauuccucccaauggcuauuuucgcuucgauagcugggugaaccaauucuacacgcuggcuccuauggggaacggcaccggacggagacgcuga

SEQ ID NO: 29777 - RNA, 1617 nt, Artificial Sequence
  derived and/or modified sequence opt5 from VP1__Norovirus_and/or_Norovirus-like__LC016607
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuaacacccacacauacagaaugaaucucgccucucagaacuggaauaacuaugaucccacggaggaaauuccugcuccccugggcaccccggacuucgugggcaaaauccaggggaugcuuacacagaccacaaagggagacggcuccacccgggggcauaaggcgacggucagcacaggauccguggauuuuaccccuaaacugggcucuguucaauucaccacagacaccgauaaugacuuugagacagggcagaacacgcgcuucacccccgugggagucauucaggauggcaauggcgcccacagaaacgaaccccaacagugggugcucccugacuacagcgggggaacaguucacaaugugcaucuggcuccggccgucgcccccaccuuuccuggcgagcagcuucuguucuuucgguccacaaugcccggguguagcggauacccuaacauggaucucgacugccugcugccccaggaaugggugcaacacuucuaucaggaggcugccccugcgcagucugauguggcucuccugcgcuuuguuaaucccgacaccggcagaguccuuuucgaguguaagcugcauaaaacgggguacgugaccguggcccacacaggccagcacgaucucgucaucccgccuaacggauauuuucgguucgacuccugggugaaccaauucuacacccuggcccccaugggcaauggggcuggaagacgccgguga

SEQ ID NO: 29778 - RNA, 1617 nt, Artificial Sequence
  derived and/or modified sequence opt5 from VP1__Norovirus_and/or_Norovirus-like__KP241915
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagagccgacggcuccacccgggggcauaaggcuacagucuacaccggaucugccgauuuugccccuaagcugggccgcgugcaauucgagacggacacaaaccacgauuuugaagcuaaucagaacaccaaauucacccccguuggggugauccaggacggaggcacaacccacagaaaugagccccaacaguggguccucccuagcuacuccggccggaacacaccgaaugugcaucuggcccccgcgguggcuccuacguuucccggggaacagcuucuguucuuucgcagcaccaugccuggauguucuggcuaucccaacauggaucucgacugccugcugccucaggaguggguucaauacuucuaucaggaggccgcccccgcucaguccgaugucgcccuccugagauuugugaauccggacacagggcgggugcuuuucgaauguaagcugcacaaaagcggauacgucaccguggcucauacaggccagcacgaucucguuauuccucccaacggguauuuuagauucgacucuugggugaaccaauucuacacccuggccccuaugggcaauggaacgggccgccggagauga

SEQ ID NO: 29779 - RNA, 1617 nt, Artificial Sequence
  derived and/or modified sequence opt5 from VP1__Norovirus_and/or_Norovirus-like__KM514065
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcuggcuuugccccuaagcuggggagagugcaauucgagacagauaccgaccaugauuuugaagccaaccagaauaccaaauucacacccguuggagugauccaggacggcagcaccacacaccggaacgagccccaacaguggguccucccuuccuacagcggccgcaauacgccgaacgugcaccuggcucccgccguggcgccuaccuuucccggggaacagcuucuguucuuuagaucuacaaugccuggauguuccggcuaucccaauauggaucucgacugccugcugccucaggaguggguucaauacuucuaucaggaggcugcccccgcccagagcgaugucgcucuccugcgguuugugaacccggacaccgggagagugcuuuucgaauguaagcugcauaaaucuggauacgucacaguggcccacaccggccagcaugaucucguuauuccucccaauggguauuuucgcuucgacagcugggugaaccaauucuacacgcuggcuccuaugggcaacggaaccggccggagacgcuga

SEQ ID NO: 29780 - RNA, 1617 nt, Artificial Sequence
  derived and/or modified sequence opt5 from VP1__Norovirus_and/or_Norovirus-like__KM268097
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuugccccuaagcugggccgcgugcaauucgagacagacaccaaucacgauuuugaagccaaccagaauaccaaauucacacccguuggggugauccaggacggaggcaccacacacagaaacgagccccaacaguggguccucccuucuuacagcggccggaauacgccgaacgugcaucuggcucccgccguggcgccuaccuuucccggggaacagcuucuguucuuucgcuccacaaugccuggauguagcggcuaucccaauauggaucucgacugccugcugccucaggaguggguucaauacuucuaucaggaggcugcccccgcccagucugaugucgcucuccugagauuugugaacccggacaccgggcgggugcuuuucgaauguaagcugcacaaauccggauacgucacaguggcccauaccggccagcacgaucucguuauuccucccaacggguauuuuagauucgacagcugggugaaucaauucuacacgcuggcuccuaugggcaacggaaccggccgccggagauga

SEQ ID NO: 29781 - RNA, 1617 nt, Artificial Sequence
  derived and/or modified sequence opt5 from VP1__Norovirus_and/or_Norovirus-like__KM268084
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcuggcccggccuagcccggauuuugacuucauuuuucucguucccccuaccguggaaucucgcacaaaacccuucuccgucccugugcugaccguugaggaaaugacgaauagcagauuucccaucccgcuugagaagcuguucaccgggccuucuuccgcuuucgugguccagccccagaacggacgguguacaaccgauggcgugcuccuggggacaacccaacugagcccugucaauauuugcacguuucgcggagacgugacacauaucaccggcucuagaaacuacacaaugaaucucgcgucccagaacuggagcaauuaugaucccaccgaggaaauuccugcuccccugggcaccccggacuucguugggaaaauccagggagugcuuacacagacgaccaagacagacggcuccacccgggggcacaaggccacagucuacaccggaucugccgauuuugccccuaaacugggccgcgugcaauucgagacggacacagaucaugacuuugaagcuaaccagaauaccaaguucacccccguuggggugauccaggauggaagcacaacccacagaaacgagccccaacaguggguccucccuuccuacagcggccggaauacaccgaacgugcaccuggcccccgcgguggcuccuacguuucccggcgaacagcuucuguucuuucgcucuaccaugccuggguguuccggauaucccaauauggaccucgauugccugcugccucaggaguggguucaauacuucuaucaggaggccgcccccgcucagagcgacgucgcccuccugagauuugugaacccggauacaggccgggugcuuuucgaauguaaacugcauaagucuggguacgucaccguggcucacacaggacagcaugaccucguuauuccucccaauggcuauuuuagauucgauagcugggugaaccaauucuacacccuggccccuauggggaacggcacgggacgccggagauga

SEQ ID NO: 29782 - RNA, 1617 nt, Artificial Sequence
  derived and/or modified sequence opt5 from VP1__Norovirus_and/or_Norovirus-like__KJ649704
augaagauggccagcuccgacgcuaaccccucugauggcagcgccgcgaaucuggugccugaggucaacaaugaaguucucgcucuggagccgguggugggggccgccaucgcugcccccgucgcuggacagcaaaacgugauugacccuuggaucagaaauaacuucguucaggcccccggcggggaauuuaccguguccccucggaaugcgcccggagagauucuuuggucugccccucugggcccggaucucaaccccuaccugagccaccuugcucgcauguauaauggguacgccggaggcuucgaaguccaggugauccuggcuggcaacgccuuuacagcggggaaaguuauuuucgccgcugugccucccaauuuuccuacggagggacucucccccucucaggucaccauguucccgcauaucgugguggacgucagacaacuggagccuguucugaucccccucccugaugugcggaacaauuuuuaucacuacaaccagagcaaugaccccacaauuaagcugaucgccaugcuuuauacaccccugcgcgcuaacaacgccggcgaugacguguucaccgucuccugcagagugcucacccggccuagcccggauuuugacuucauuuuucugguucccccuacaguggaaucucgcaccaaacccuucuccgucccugugcuuacgguugaggaaaugaccaauagcagauuucccaucccgcuggagaagcuguucacagggccuucuuccgccuucgugguccagccccagaacggacgguguaccacagauggcgugcugcuggggaccacgcaacucagcccugucaauauuugcacauuucgcggagacgugacccauaucacaggcucucacaacuacaccaugaaucuggcuucccagaacuggaauaacuaugaucccaccgaggaaauuccugcgccccuuggcacaccggacuucguugggaaaauccagggagugcugacgcagaccacaagaaccgacggcagcacacgggggcauaaggccaccgucuacacgggauccgcugauuuuucuccuaagcucggccgcauccaauucgagacagacaccaaucacgauuuugaagccaaccagaauaccaaauucacacccguggggguuauucaggacggaggcaccacacacagaaacgagccccaacagugggugcugccuagcuacuccggccggaauacgccgaacguccaucuugcccccgcuguggccccuaccuuucccggggaacagcuccucuucuuucgcagcacaaugccuggauguucuggcuaucccaauauggaucuggacugccugcucccucaggagugggugcaauacuucuaucaggaggcggcucccgcccaguccgauguugcccugcuuagauuugucaacccggacaccgggcgggugcuguucgaauguaagcuccacaaaagcggauacgugacagucgcucauaccggccagcacgaucuggugaucccucccaacggguauuuuagauucgacucuuggguuaaucaauucuacacgcuugccccuaugggcaacggaaccggccgccggagauga

SEQ ID NO: 29783 - RNA, 1617 nt, Artificial Sequence
  derived and/or modified sequence opt5 from VP1__Norovirus_and/or_Norovirus-like__KC577174
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcuccaacuacaccaugaaucucgccucucagaacuggaauagcuaugauccuaccgaggaaauccccgcuccucugggcacacccgacuucgucgggaaaauucagggagugcuuacgcagaccacaagaaccgacggcuccacacgggggcacaaggcgaccguuuacacgggaagcgccgauuuuucuccgaagcugggccgcgugcaauucgcuacagacaccgauaacgacuuugagaccaaucagaacacaaaauucaccccugucggggugauccaggauggagccacaacgcauagaaaugaaccccaacaguggguucuccccuccuacagcggccggaacacccacaaugugcaccuggccccugcugucgccccgacauuucccggcgagcagcuucuguucuuucgcucuaccaugccuggguguagcggauaucccaacauggaccucgauugccugcugccucaggaaugggugcaauacuucuaucaggaggcggcucccgcccaguccgacguggcccuccugagauuuguuaauccugauacaggccggguccuuuucgaguguaagcugcauaaaucuggguacgugaccguggcucacacgggacagcaugaccucgucauucccccgaacggcuauuuuagauucgauagcugggugaaccaauucuacacccuggccccuauggggaauggcacaggacgccggagauga

SEQ ID NO: 29784 - RNA, 1617 nt, Artificial Sequence
  derived and/or modified sequence opt5 from VP1__Norovirus_and/or_Norovirus-like__KF177451
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgauaaugacuuugaagccaaccagaauaccaaauucacacccguuggggugauccaggauggaggcaccacacaucggaacgagccccaacaguggguccucccuucuuacagcggccgcaauacgcacaacgugcaccuggcuccggccguggcgcccaccuuuccuggggaacagcuucuguucuuuagauccacaaugcccggauguagcggcuauccuaauauggaccucgauugccugauuccccaggaguggguucaauacuucuaucaggaggcugccccugcccagucugacgucgcucugcuccgguuugugaaccccgauaccgggagagugcuguucgaauguaaacuucauaaguccggauacgucacaguggcccacaccggccagcaugaccugguuaucccgccuaacggguauuuucgcuucgauagcugggugaaucaauucuacacgcucgcucccaugggcaacggaaccggccggagacgcuga

SEQ ID NO: 29785 - RNA, 1617 nt, Artificial Sequence
  derived and/or modified sequence opt5 from VP1__Norovirus_and/or_Norovirus-like__KF177429
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgccgaaugugcaccuggcucccgccguggcgccuaccuuucccggggaacagcuucuguucuuuagauccacaaugccuggauguagcggcuaucccaacauggaccucgauugccugcugccucaggaguggguucaauacuucuaucaggaggcugcccccgcccagucugacgucgcucuccugcgguuugugaauccggauaccgggagagugcuuuucgaauguaagcugcauaaauccggauacgucacaguggcccacagcggccagcaugaccucguuauuccucccaacggguauuuucgcuucgauucuugggugaaccaauucuacacccuggcuccuaugggcaauggaacgggccggagacgcuga

SEQ ID NO: 29786 - RNA, 1617 nt, Artificial Sequence
  derived and/or modified sequence opt5 from VP1__Norovirus_and/or_Norovirus-like__KF060005
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuacaccuaagcugggcagagugcaauucgcuaccgacaccgauaaugacuuugucacaaaucagaacaccaaauucacacccguggggguuauccaggauggauccacgacaccccggaaugagccucaacagugggugcucccgagcuacucuggccgcaacacccauaauguccaccuggcccccgccguggcuccuaccuuucccggcgaacagcuucuguucuuuagauccacaaugccuggguguagcggauaucccaacauggaccucgauugccugcugccucaggagugggugcaauacuucuaucaggaagccgcgcccgcucagucugacguugcccuccugcgguuugucaauccggauaccggcagagugcuuuucgaguguaagcugcacaaaagcggguacgugacggucgcccauaccggacagcacgaccucgugauuccucccaacggcuauuuucgcuucgauuccuggguuaaccaauucuacacacuggcuccuauggggaauggcaccggacggagacgcuga

SEQ ID NO: 29787 - RNA, 1617 nt, Artificial Sequence
  derived and/or modified sequence opt5 from VP1__Norovirus_and/or_Norovirus-like__JX439821
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuuccagcagaaacuacaccaugaaucucgccucccagaacuggucuagcuaugaucccaccgaggaaaucccugcuccccugggcacaccggacuucgucggcaaaauucagggggugcuuacgcagaccacacggaccgacggauccacacgcggccacaaggcgaccguuuacacggggagcgccgauuuuucuccuaagcugggaagagugcaauucgacacagauaccgacaaugauuuugagaccaaccagaauacaaaauucacccccgucggcgugauccaggacggguccacaacguaccggaacgaaccccaacaguggguucucccuagcuauucuggacgcaauacccauaacgugcaccuggcuccggccgucgcccccacauuuccuggcgagcagcuucuguucuuuagaagcaccaugcccggcuguuccggguacccuaauauggaucucgacugccugcugccccaggaaugggugcaauauuucuaccaggaggcugccccugcgcagucugauguggcucuccugcgguuuguuaaccccgacacaggaagaguccuuuucgaguguaagcugcacaaaagcggcuaugugaccguggcccauacggggcagcacgaucucgucauuccgccuaauggauacuuucgcuucgacuccugggugaaccaauucuauacccuggcccccaugggcaacgggacaggccggagacgcuga

SEQ ID NO: 29788 - RNA, 1617 nt, Artificial Sequence
  derived and/or modified sequence opt5 from VP1__Norovirus_and/or_Norovirus-like__KC517361
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacaucacccauauuacaggcucuagaaacuacaccaugaaucucgcuucccagaacuggaauaacuaugaucccaccgaggaaaucccugcgccccugggcacaccggacuucguggggaaaauccagggaguucuuacgcagaccacacggaccgacggcagcacacgcgggcacaaggccaccgugcauacgggauccgcugauuuugccccuaagcugggcagaguccaauucgagacagacaccgaucacgacuuugaagccaaucagaacaccaaauucacacccguggggguuauucaggauggaggcaccacacaccggaaugagccccaacagugggugcucccuucuuacagcggccgcaacacgcauaauguccaccuggcuccggccguggcgcccaccuuuccuggggaacagcuucuguucuuuagauccacaaugcccggauguagcggcuacccuaacauggaccucgauugccugcugccccaggagugggugcaauauuucuaccaggaggcugccccugcccagucugacguugcucuccugcgguuugucaaucccgauaccgggagagugcuuuucgaauguaagcugcauaaauccggauaugugacagucgcccacaccggccagcacgaccucgugaucccgccuaacggguacuuucgcuucgauagcuggguuaaccaauucuauacgcuggcucccaugggcaauggaaccggccggagacgcuga

SEQ ID NO: 29789 - RNA, 1617 nt, Artificial Sequence
  derived and/or modified sequence opt5 from VP1__Norovirus_and/or_Norovirus-like__KC175378
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugagccucgcgucucugaauuggaacaauuaugacccuacagaagagauucccgccccucuugggacgcccgauuucgugggaaaaauccagggcguccugacccagacaaccaagggggacggauccacacggggccacaaggcuaccguguacacggggagcgccccguuuacaccuaaacucggauccguucaguucucuaccgacaccgaaaacgauuuugagacacaucaaaauaccaaguucacacccgugggcgucauucaggacggcgggacgacccaccgcaacgaaccccagcaaugggugcugccuagcuacuccggaagagauguucacaaugugcaucuugccccggcugucgcccccacauuuccuggcgagcagcuccuguucuuucggagcaccaugcccggguguucuggauauccuaacauggaccuggauugccugcucccccaggagugggugcagcacuucuaccaagaagcggcuccugcccaguccgacguggcccugcuucgcuuuguuaaucccgauacaggcagaguccuguucgaguguaaacuccauaagagcggguaugugaccguggcucacacgggccagcacgaccuggucaucccgccuaacggauacuuucgguucgauucuugggugaaucaguucuauacccuugcccccaugggcaacgggacaggaagacgccgguga

SEQ ID NO: 29790 - RNA, 1617 nt, Artificial Sequence
  derived and/or modified sequence opt5 from VP1__Norovirus_and/or_Norovirus-like__JX459648
augaagauggccagcaacgacgcuaaucccuccgagggcucugccgcgaaccuggugccugaagucaauaacgagguuauggcucucgaaccgguggugggggccgccaucgcugcccccgucgcuggacagcaaaaugugauugauccuuggaucagaaacaauuucguucaggcccccggcggggaguuuaccgugagcccucggaacgcgcccggaacaauucgcugguccgccccucugggcccggaccuuaaucccuaccugucucaccucgcuagaauguauaacggguacgccggaggcuucgaaguccaggugauccuggcuggcaaugccuuuacggcggggaaaauuaucuucgccgcuguuccucccaacuuuccuaccgagggacuuagccccucccaggugacaauguucccgcauaucauugucgaugugcggcaacuggagccugugcucaucccccugccugacguccgcaauaacuuuuaucacuacaaucagucuaacgauagcaccauuaagcugaucgccaugcucuauacaccccugagagcuaacaaugccggcgaagacguuuucaccguguccugccgggugcuuacacgccccagcccugauuuugacuucauuuuucuggucccgcccaccguggagucuagaacgaaaccuuucaccguucccauccucacaguggaagagaugaccaacucccgguuuagcauuccucuggagaaacuuuucacagggcccucuggagccuucgucgugcagccgcagaauggccgcuguaccacggaugggguucugcucggaacaacccaacuguccccugugaacaucugcacauuuagaggcgacgucacccauaucgcuggcagccggaauuacaccaugaaccuggcggcccucaauuggaacaauuaugaucccacagaagagauuccugcuccccuggggacgccugacuucgugggaaagauccagggcguccuuacccagacaaccaagggggauggaucuacacgcggccacaaggccaccguguacacgggguccgccgacuuuacacccaaacugggaagcguucaguucuccaccgacaccgaaaacgauuuugagucucaucaaaauacaaaguucaccccggugggcgucauucaggacggcagcacaacgcacagaaacgaaccucagcaaugggugcuccccuccuacagcgggcggaauguucacaacgugcaucuggcucccgccgucgcgccuaccuuuccgggagagcagcuucuguucuuucgcucuacaaugcccggcuguuccggguauccuaauauggaucucgacugccugaucccccaggagugggugcagcacuucuaccaagaagcugccccugcccagagcgauguggcucugcucagauuuguuaaccccgacaccggacggguccuguucgaguguaaacuucauaagucuggcuaugugacaguggcccacaccgggcagcacgaucuggucauuccucccaacggcuacuuuagauucgacagcugggugaaucaguucuauacgcucgcuccgaugggaaacggcgccgggcgccggagauga

SEQ ID NO: 29791 - RNA, 1617 nt, Artificial Sequence
  derived and/or modified sequence opt5 from VP1__Norovirus_and/or_Norovirus-like__JX459635
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauucucgacgucagacaacuggagccugugcugaucccccucccugaugugcggaauaacuuuuaucacuacaaucagucuaacgacagcacaauuaagcugaucgccaugcuuuauacaccccugcgcgcuaacaaugccggcgaagaugucuucaccguuuccugcagagugcucacccggcccagcccugacuuugauuucauuuuucuggugccgcccacagucgagucucgcaccaaaccuuucacggugcccauccuuaccguugaagagaugacaaacuccagauuuccuauuccccuggagaaacucuucaccgggccgagcggagccuucgugguccagccucagaauggccgguguacaaccgacggggugcugcugggaacgacacaacucucucccguuaacaucugcaccuuucgcggcgaugugacacauaucgcuggcuccagaaauuacaccaugaaccuggcgagccuuaauuggaacaauuaugacccuaccgaagagauucccgccccucuggggacacccgauuucgucggaaagauccagggcgugcucacgcagaccacaaagggggacggaucuacccggggccacaaggcuacagucuacaccggguccgccccguuuacgccuaaacugggaagcgugcaguucuccacagacaccgaaaacgauuuugagacccaucaaaauacaaaguucacccccguuggcgugauucaggacggcucuacaacgcgcagaaacgaaccccagcaauggguccuuccuagcuacuccgggcggaaugcccacaacgugcaccuggcuccggccguugcgcccaccuuuccuggagagcagcuccuguucuuucgcagcacaaugcccggcuguucuggguauccuaauauggaucuggacugccuccugccccaggagugggugcagcauuucuaccaagaagcugccccugcccaguccgaugucgcucuccugagauuugugaaccccgacaccggacgggugcuuuucgaguguaaacugcacaagagcggcuauguuacagucgcccauaccgggcagcacgaucuugugaucccgccuaacggcuacuuuagauucgacucuugggugaaucaguucuauacgcuggcucccaugggaaacggcaccgggcgccggagauga

SEQ ID NO: 29792 - RNA, 1617 nt, Artificial Sequence
  derived and/or modified sequence opt5 from VP1__Norovirus_and/or_Norovirus-like__JX459624
augaagauggccagcaacgacgcucaccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccgugagcccucggaaugcgcccggagagauucugugguccgccccucuuggcccggaucugaaccccuaccucucucaucuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcacaucauugucgacgugagacaacucgagccugugcugaucccccugccugauguccggaacaauuuuuaucauuacaaccagucuaaugacagcacaauuaagcucaucgccaugcuguauacaccccuucgcgcuaacaacgccggcgaagauguuuucaccguguccugcagagugcugacccggcccagcccugacuuugauuucauuuuucucgucccgcccacaguggagucucgcaccaaaccuuucacgguucccauccugaccguggaagagaugacaaauuccagauuuccuauuccccuugagaagcuguucaccgggccgagcggagccuucgucgugcagccucagaacggccgguguacaaccgacgggguucuccugggaacgacacaacugucucccgugaauaucugcaccuuucgcggcgaugucacacacaucgcuggcaccagaaacuacaccaugaaucucgcgucccugaacuggaauaacuaugacccuacagaagagauucccgccccucuugggcccccggauuucgugggaaaaauccagggcguccugacgcagaccacaaagggggacggaagcacccggggccauaaggcuacaguguacaccgggucugccccuuuuacgcccaaacucggauccguucaguucagcacagacaccgaaaaugauuuugagacccaccaaaacacaaaguucacccccgugggcgucauucaggacggcgggacaacgcaccgcaaugaaccucagcaaugggugcugccguccuacucuggaagaaacguucauaaugugcaccuugcccccgcugucgccccuaccuuucccggcgagcagcuccuguucuuucggagcacaaugccuggguguuccggauaucccaacauggaucuggacugccugcucccucaggagugggugcagcauuucuaccaagaagcggcucccgcccagagcgauguggcccugaugcgcuuuguuaauccggacaccggcagaguccuuuucgaguguaaacugcacaagucuggguaugugacaguggcucacaccggccagcaugaucucgucaucccucccaacggauacuuucgguucgacuccugggugaaccaguucuauacgcuggccccuaugggcaaugggaccggaagacgccgguga

SEQ ID NO: 29793 - RNA, 1617 nt, Artificial Sequence
  derived and/or modified sequence opt5 from VP1__Norovirus_and/or_Norovirus-like__JX459614
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcgggacaacgcaccgcaacgaaccccagcaaugggugcugccuucuuacagcggaagaaauguucacaacgugcaucuugccccggcugucgcccccaccuuuccuggcgagcagcuccuguucuuucgguccacaaugcccggguguagcggauauccuaauauggaucuggacugccugcucccccaggagugggugcagcacuucuaccaagaagcggcuccugcccaguaugauguggcccugcuucgcuuuguuaaccccgacaccggcagaguccuguucgaguguaaacuccauaagucuggguacgugacaguggcucacaccggccagcacgaucuggucaucccgccuaacggauauuuucgguucgacuccugggugaaucaguucuacacgcuugcccccaugggcaacgggaccggaagacgccgguga

SEQ ID NO: 29794 - RNA, 1617 nt, Artificial Sequence
  derived and/or modified sequence opt5 from VP1__Norovirus_and/or_Norovirus-like__HM635103
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugaucucgagaccaaccagaauacaaaauuuacccccgucggggugauccaggacggauccacaacgccucggaacgaaccgcaacaguggguucugcccagcuacucuggccgcaauauucauaacgugcaccuugccccugccgucgcucccaccuucccuggcgagcagcugcucuuuuucagauccacaaugcccggguguagcggauauccuaauauggaucuggacugccugcucccccaggaaugggugcaauacuuuuaucaggaggccgcgccggcucagucugauguggcccugcuucgguucguuaacccugacaccggcagaguccuguuugaguguaagcuccacaaaagcggguacgugacaguggcccauaccggacagcacgaucuggucauucccccuaacggcuauuuccgcuuugacuccugggugaaucaauucuacacgcuugcucccauggggaacggcaccggacggagacgcuga

SEQ ID NO: 29795 - RNA, 1617 nt, Artificial Sequence
  derived and/or modified sequence opt5 from VP1__Norovirus_and/or_Norovirus-like__JQ613522
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagagacuacaccaugaaccucgcgucucugaauuggaacaauuaugauccuaccgaagagauucccgccccucuugggacacccgacuucgugggaaaaauccagggcaugcugacgcagaccacaaagggggacggauccacccggggccacaaggcuacagucuacaccgggagcgccccguuuacgccuaaacucggauccgugcgcuucucuacagauaccgaaaacgacuuugagacccaucagaauacaaaguucacccccguuggcgugauucaagauggcagcacaacgcacagaaacgaaccccagcaguggguccugccuuccuacagcgggcgggacgugcacaauguucaucuugccccggcuguggcccccaccuuuccuggagagcaacuccuguucuuucgcucuacaaugcccggcuguuccggguauccuaacauggaucuggacugccugcucccccaggaguggguccagcacuucuaccaggaagcggcuccugcccaaagcgauguggcccugcuuagauuugugaaucccgacaccggacggguucuguucgaguguaaacuccauaagucuggcuaugucacaguggcucacaccgggcagcacgaucuggugaucccgccuaacggcuacuuuagauucgacagcugggucaaucaguucuauacgcuugcccccaugggaaacggcaccgggcgccggagauga

SEQ ID NO: 29796 - RNA, 1617 nt, Artificial Sequence
  derived and/or modified sequence opt5 from VP1__Norovirus_and/or_Norovirus-like__AB629942
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacacccaaaacgauuuugaaacccaucagaauacaaaguucacccccgugggagucauucaggacggcggcacaacgcaccgcaacgagccccaacagugggugcugccuagcuacuccgggagaaauguuccgaacgugcaccuugcccccgcugucgccccuaccuuucccggagaacagcuccuguucuuucggagcacaaugccuggcuguucuggguaucccaauauggaucuggacugccugcucccucaggagugggugcaacauuucuaccaggaggcggcucccgcccaguccgauguggcccugcuucgcuuuguuaacccggacaccggaagaguccuguucgaauguaaacuccacaagagccgguaugugacaguggcucauaccggccagcacgaucuggucaucccucccaacggguacuuuagauucgacucuugggugaaucaauucuauacgcuugccccuaugggcaacggaaccggccgccggagauga

SEQ ID NO: 29797 - RNA, 1617 nt, Artificial Sequence
  derived and/or modified sequence opt5 from VP1__Norovirus_and/or_Norovirus-like__GQ856457
augaagauggccagcaacgacgcuaaucccuccgauggcccugccgcgaaccuggugccggaggucaauaacgaaguuauggcucucgagcccguggugggggccgccaucgcugccccugucgcuggacagcaaaaugugauugaccccuggaucagaaacaauuucguucaggccccuggcggggaauuuaccgugucuccccggaacgcgccuggagagauucuguggagcgccccgcuuggccccgaucugaauccuuaccucucccaccuggcucgcauguauaacggguacgccggaggcuucgaaguccaggugauccuugcuggcaaugccuuuacagcggggaaaauuaucuucgccgcuguucccccuaacuuucccacggagggacugucuccgagccaggugaccauguucccucauaucauugucgacgugagacaacucgagcccgugcugaucccucugcccgauguccggaauaacuuuuaucacuacaaucaguccaacgacucuacaauuaagcucaucgccaugcuguauacaccccuucgcgcuaacaaugccggcgaagauguuuucaccgugagcugcagagugcugacccggccuuccccggacuuugauuucauuuuucucgugcccccuacagucgagagccgcaccaaacccuucacgguuccuauccugaccguggaagagaugacaaacucuagauuucccauuccgcuugagaagcuguucaccgggccuuccagcgccuucgucgugcagccccagaauggacgguguacaaccgacggcguucuccuggggacgacacaacugucuccugugaacaucugcaccuuucgcggagaugucacacauaucgcuggcuccagcaauuacaccaugaaccucgcgucucugaauuggaacaauuaugaccccaccgaagagauuccugcuccccuuggcacaccggauuucguggggaaaauccagggaguccugacgcagaccacaaagggcgacggguccaccagaggacacaaggccacaguguacaccggcagcgccccuuuuacgcccaaacucggguccguucaguucucuacagacacccaaaacgauuuugaaacccaucagaauacaaaguucacccccgugggagucauucaggacggcggcacaacgcaccggaacgagccucaacagugggugcugccgagcuacuccgggcgcaauguucagaacgugcaccuugcccccgcugucgccccuaccuuucccggagaacagcuccuguucuuuagaagcacaaugccuggcuguucuggguaucccaauauggaucuggacugccugcucccucaagagugggugcagcauuucuaccaggaggcggcucccgcccaguccgauguggcccugcuucgguuuguuaacccggacaccggacgcguccuguucgaauguaaacuccacaagagcagauaugugacaguggcucauaccggccaacacgaucuggucaucccucccaacggguacuuucgguucgacucuugggugaaucaguucuauacgcuugccccuaugggcaacggaaccggcagacgccgguga

SEQ ID NO: 29798 - RNA, 1617 nt, Artificial Sequence
  derived and/or modified sequence opt5 from VP1__Norovirus_and/or_Norovirus-like__EU876883
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaaugagcccgcauaucauugucgacgugagacaacucgagccugugcugaucccccugccugauguccggaacaauuucuaucacuacaaccaguccaaugaccccaccauuaagcucaucgcuaugcuguauacaccccuucgcgccaacaacgcuggcgaugacguuuuuaccgugagcugcagagugcugacacggccuucuccggauuucgacuuuauuuuccucgugcccccuaccgucgaaucccgcacgaaacccuuuagcguuccuauccugaccguggaggaaaugacaaauucuagauuccccauuccgcuugagcggcuguuuaccgggccuuccagcgccuucgucgugcagccccagaacggacgcuguacaaccgauggcguucuccuggggacgacacaacugucuccugugaauaucugcaccuucagaggagacgucacacauaucgccggcacccaggaguacaccaugaaccucgcuucccagaauuggaacaauuaugaucccacagaagagauuccugcgccccugggcacgccggacuuuguggggaagauccagggaguccuuacccaaacaacccggcgcgacggcagcacaagagggcacaaagccaccguguccacgggaucuguucauuucacaccuaagcugggccggauucaguuuagcaccgauaccuccaacgacuucgaaacagggcagaauacccgcuuuacacccgugggagucgugcaagauggcggcacgacccaccagaacgagccccagcaguggguucucccuaauuacagcgggagagacggacacaacgugcaucuggcuccggccgucgcccccucuuucccuggcgaacaacuucuguuuuuccgguccacaaugcccggguguagcggauacccuaauaugaaccucgauugccugcugccccaggagugggugcagcacuuuuaucaggaggcugccccugcgcaaucugacguggcucuccugagauucguuaaucccgauaccggccgcguccuuuuugaauguaagcugcauaaaagcggguacgugacaguggcccacaccggccagcacgaccucgucaucccgccuaacggauauuuccgguuugauuccugggugaaccaguucuacacgcuggcccccaugggcaaugggaccggaagacgccgguga

SEQ ID NO: 29799 - RNA, 1617 nt, Artificial Sequence
  derived and/or modified sequence opt5 from VP1__Norovirus_and/or_Norovirus-like__AB447455
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcaccagaaauuacaccaugaaccucgcgucccugagcuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagaaacguucacaaugugcaucuugccccggcugucgcccccacauuuccuggcgagcagcuccuguucuuucgguccaccaugcccggguguagcggauauccuaacauggaucuggacugccugcucccccaggagugggugcagcacuucuaccaagaagcggcuccugcccagucugauguggcccugaugcgcuuuguuaaucccgacacaggcagaguccuuuucgaguguaaacugcauaaguccggguaugugaccguggcucacacgggccagcacgaucucgucaucccgccuaacggauacuuucgguucgacagcugggugaaccaguucuauacccuggcccccaugggcaaugggacaggaagacgccgguga

SEQ ID NO: 29800 - RNA, 1617 nt, Artificial Sequence
  derived and/or modified sequence opt5 from VP1__Norovirus_and/or_Norovirus-like__EU078409
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaagauucacgcccguuggcgugguccaggaugggaacggaacccaccaaaaugagccccagcagugggugcucccuuccuacagcggccggacagggcauaacguucaccuggcuccggccguggcccccaccuuuccuggagaacagcuucuguucuuucgcuccacaaugcccggcuguucuggguacccuaacaugaaucucgacugccugcugccccaagaguggguccagcauuucuaucaggaggcugccccugcgcagagcgauguggcucuccugagauuugugaaccccgacaccggccggguucuuuucgaauguaagcugcacaaauccggauacgucacgguggcccacaccggccaacaugaucucgugaucccgccuaauggguauuuuagauucgacagcugggucaaccaguucuacacacuggcccccaugggaaauggcaccgggcgccggagauga

SEQ ID NO: 29801 - RNA, 1617 nt, Artificial Sequence
  derived and/or modified sequence opt5 from VP1__Norovirus_and/or_Norovirus-like__AB303928
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacacuccgcggcgaugucacccauaucgccggcacccacaauuacacaaugaaccuggcuucucagaauuggaacaauuaugaccccacggaagagauuccugcgccccuugggaccccggauuuugugggaagaauccagggcguccugacacagaccacacgcggggacggauccacccggggccauaaagccacggugagcacaggggacguucacuucaccccuaagcucggaucugugcaauuuaacaccgauacaaauaacgacuucgaaauuggccagaauaccagauuuacacccgucggcgugguucaggaugggaacggaacgcaccaaaaugagccccagcagugggugcugccuuccuacagcggccggaccgggcauaacguccaccuugcuccggccguggcccccacauucccuggagaacagcugcucuuuuuccgcuccaccaugcccggcuguucuggguacccuaacaugaaucuggacugccugcucccccaagagugggugcagcauuuuuaucaggaggcugccccugcgcagagcgauguugcucugcuuagauucgucaaccccgacacaggccgggugcuguuugaauguaagcuccacaaauccggauacgugaccgucgcccacacgggccaacaugaucuggugaucccgccuaauggguauuucagauuugacagcuggguuaaccaguucuacacccuugcccccaugggaaauggcacagggcgccggagauga

SEQ ID NO: 29802 - RNA, 1617 nt, Artificial Sequence
  derived and/or modified sequence opt5 from VP1__Norovirus_and/or_Norovirus-like__AY502023
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagcucaacgaccccaccauuaagcugaucgcuaugcuuuauacaccccugcgcgccaacaaugcuggcgaagauguuuucaccgugucuugcagagugcucacacggccuagcccggacuuugauuucauuuuucuggugcccccuaccgucgagucccgcacgaaacccuucaccguuccuauccuuacaguggaagagaugaccaacagcagauuucccauuccgcuggagaagcuguucacagggccuucuggagccuucgucgugcagccccagaauggccgguguaccacggacgggguucugcugggaacaacccaacucuccccugugaacaucugcacauuucgcggcgaugucacccauaucgccggcacccacaauuacacaaugaaccuggcuagccagaauuggaacaauuaugaccccacggaagagauuccugcgccccuugggaccccggauuucgugggaagaauccagggcaugcugacacagaccacacgcggggacggaucuacccggggccauaaagccacggucuccacaggggacgugcacuuuaccccuaagcucggaagcauucaauucaacaccgauacaaauaacgacuuugaaaccggccagaauacaaaguucacgcccguuggcgugguccaggaugggaacggaacccaccaaaaugagccccagcagugggugcugccuucuuacuccggcagaacagggcauaacguucaccuugcuccggccguggcccccaccuuuccuggagaacagcuccucuucuuucggagcacaaugcccggcuguuccggguacccuaacaugaaucuggacugccugcucccccaagaguggguccagcauuucuaucaggaggcugccccugcgcagucugauguggcucugcuucgcuuugugaaccccgacaccggcagaguucuguucgaauguaaacuccacaagagcggauacgucacgguggcccacaccggccaacaugaucuggugaucccgccuaauggguauuuucgguucgacuccugggucaaccaguucuacacacuugcccccaugggaaauggcaccgggagacgccgguga

SEQ ID NO: 29803 - RNA, 1617 nt, Artificial Sequence
  derived and/or modified sequence opt5 from VP1__Norovirus_and/or_Norovirus-like__KU678202
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggaaugcuuacgcagaccacaagaaccgacggcuccacacgggggcauaaggccaccguguacacgggaucugcugauuuugccccuaagcugggccgcguccaauucgagacagacaccaacaaugauuuugaagccaaccagaauaccaaauucacacccguggggguuauccaggacggaggcaccacacacagaaacgagccccaacagugggugcucccuagcuacuccggccggaauacgccgaacguccaccuggcucccgccguggcgccuaccuuucccggggaacagcuucuguucuuucgcagcacaaugccuggauguucuggcuaucccaauauggaucucgacugccugcugccucaggagugggugcaauacuucuaucaggaggcugcccccgcccaguccgauguugcucuccugagauuugucaacccggacaccgggcgggugcuuuucgaauguaagcugcauaaaagcggauacgugacagucgcccacaccggccagcaugaucucgugauuccucccaacggguauuuuagauucgacucuuggguuaaucaauucuacacgcuggcuccuaugggcaacggagccggccgccggagauga

SEQ ID NO: 29804 - RNA, 1617 nt, Artificial Sequence
  derived and/or modified sequence opt5 from VP1__Norovirus_and/or_Norovirus-like__KX371607
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaggcaccacacaucgcaacgagccccaacaguggguccucccuagcuacuccggcagaaauacgccgaacgugcaccuggcucccgccguggcgccuaccuuucccggggaacagcuucuguucuuucggagcacaaugccuggauguucuggcuaucccaauauggaccucgauugccugcugccucaggaguggguucaauacuucuaucaggaggcugcccccgcccaguccgacgucgcucuccugagauuugugaacccggauaccgggcgcgugcuuuucgaauguaagcugcacaaaagcggauacgucacaguggcccauaccggccagcacgaccucguuauuccucccaauggguauuuucgguucgauucuugggugaaccaauucuacacgcuggcuccuaugggcaacggaaccggcagacgccgguga

SEQ ID NO: 29805 - RNA, 1617 nt, Artificial Sequence
  derived and/or modified sequence opt5 from VP1__Norovirus_and/or_Norovirus-like__KX354112
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaucuaccacacaccggaaugagccccaacaguggguccucccuagcuacuccggccgcaacacgcacaaugugcaucuggcuccggccguggcgcccaccuuuccuggcgaacagcuucuguucuuuagaagcacaaugcccggguguucuggauauccuaacauggaccucgauugccugcugccccaggaguggguucaauacuucuaucaggaggcugccccugcccaguccgacgucgcucuccugcgguuugugaaucccgauaccggcagagugcuuuucgaauguaagcugcacaaaagcggguacgucacaguggcccauauuggacagcacgaccucguuaucccgccuaacggcuauuuucgcuucgauucuugggugaaccaauucuacacccuggcucccauggggaauggcacgggacggagacgcuga

SEQ ID NO: 29806 - RNA, 1617 nt, Artificial Sequence
  derived and/or modified sequence opt5 from VP1__Norovirus_and/or_Norovirus-like__KX353993
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugguucuugccggcaaugcuuuuacggccgggaaaaucauuuucgcggccgugccucccaacuuuccuaccgagggacugucucccagccaggucacaauguucccgcauaucaucguggacgugagacaacucgagccuguccugauuccccugccugauguucggaauaacuuuuaucacuacaaucaguccaacgaccccaccaucaagcucauugcuaugcuguauacaccccuucgcgccaauaacgcuggcgaugacguguucaccgugagcugcagaguccugacacggccuucuccggauuuugacuucaucuuucucgugcccccuaccguugaaucccgcacgaaacccuucagcgugccuguccugaccguggaggaaaugacaaacucuagauuucccauuccgcuugagaagcuguucaccgggccuuccagcgccuucguugugcagccccagaauggacgguguacaaccgauggcguccuccuggggacgacacaacugucuccugugaacaucugcaccuuucgcggagacgucacacauauucccggcuccagaaauuacaccaugaaccucgccagccagaauuggaacuccuaugauccuaccgaggaaauccccgcuccgcugggcacaccugacuucguggggaaaauccagggaguucuuacgcagaccacacggaccaauggcucuacacgcgggcacaaggcgaccguguacacgggaagcgccgacuuuucccccaagcugggcagaguccaauucgcuacagauaccgacaacgauuuugagaccaaucagaacacaaaauucacccccguggggguuauucaggacggagccacaacgccucggaaugaaccgcaacagugggugcuccccagcuacucuggccgcaacauccauaauguccaccuggccccugcuguggcccccaccuuuccuggcgagcagcuucuguucuuuagauccacaaugcccggguguagcggauauccuaacauggaucucgacugccugcugccccaggaaugggugcaauacuucuaucaggaggcggcuccggcccagucugauguugcccuccugcgguuugucaauccugacaccggcagagugcuuuucgaguguaagcugcacaaaagcggguacgugacagucgcucauaccggacagcacgaucucgugauucccccuaacggcuauuuucgcuucgacuccuggguuaaccaauucuacacgcuggcccccauggggaauggcaccggacggagacgcuga

SEQ ID NO: 29807 - RNA, 1617 nt, Artificial Sequence
  derived and/or modified sequence opt5 from VP1__Norovirus_and/or_Norovirus-like__KR131762
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcaugcugacgcagaccacaaagggggacggauccacccggggccacaaggcuacagucuacaccgggagcgccccguuuacgccuaaacucggauccgugcaguucucuacagacaccgaaaaugauuuugagacccaucaaaacacaaaguucacccccguuggcgugauucaggacggcagcacaacgcaccgcaaugaaccccagcaauggguccugccuuccuacagcgggagagaugugcacaacguucaucuugccccggcuguggcccccaccuuuccuggagagcagcuccuguucuuucggucuacaaugcccggcuguuccggguauccuaauauggaccuggauugccugcucccccaggaguggguccagcacuucuaccaagaagcggcuccugcccagagcgacguggcccugcuucgcuuugugaaccccgauaccggaagaguucuguucgaguguaaacuccauaagucuggcuaugucacaguggcucacaccgggcagcacgaccuggugaucccgccuaauggcuacuuucgguucgauagcugggucaaccaguucuauacgcuugcccccaugggaaacggcaccgggagacgccgguga

SEQ ID NO: 29808 - RNA, 1617 nt, Artificial Sequence
  derived and/or modified sequence opt5 from VP1__Norovirus_and/or_Norovirus-like__AB972519
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgccgaaugugcaccuggcucccgccguggcgccuaccuuucccggggaacagcuucuguucuuuagauccacaaugccuggauguagcggcuaucccaacauggaccucgauugccugcugccucaggaguggguucaauacuucuaucaggaggcugcccccgcccagucugacgucgcucuccugcgguuugugaauccggauaccgggagagugcuuuucgaauguaagcugcauaaauccggauacgucacaguggcccacaccggccagcaugaccucguuauuccucccaacggguauuuucgcuucgauagcugggugaaccaauucuacacgcuggcuccuaugggcaauggaaccggccggagacgcuga

SEQ ID NO: 29809 - RNA, 1617 nt, Artificial Sequence
  derived and/or modified sequence opt5 from VP1__Norovirus_and/or_Norovirus-like__AB972498
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggagcucgacugccugcugccucaggaguggguucaauacuucuaucaggaagcugcccccgcccaguccgaugucgcucuccugcgguuugugaacccggacaccgggagagugcuuuucgaguguaagcugcauaaaagcggauacgucacaguggcccacaccggccagcaugaucucguuauuccucccaauggguauuuucgcuucgacucuugggugaaccaauucuacacgcuggcuccuaugggcaacggaaccggccggagacgcuga

SEQ ID NO: 29810 - RNA, 1617 nt, Artificial Sequence
  derived and/or modified sequence opt5 from VP1__Norovirus_and/or_Norovirus-like__AB972488
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugugccuaagcugggcagaguucaauucgagacagacaccgaucaugacuuugaagccaaccagaauaccaaauucacacccgugggggucauccaggauggaagcaccacacaccggaacgagccccaacagugggugcucccuuccuacagcggccgcaauacgccgaacgugcaccuggcccccgcuguugccccuaccuuucccggcgaacagcuucuguucuuuagaucuacaaugccuggguguuccggauaucccaauauggaccucgauugccugcugccucaggaguggguccaauacuucuaucaggaggcggcucccgcccagagcgacguggcccuccugcgguuugugaacccggauaccggcagaguccuuuucgaauguaagcugcauaaaucuggguacgugacaguugcucacaccggacagcaugaccucgugauuccucccaauggcuauuuucgcuucgauagcugggucaaccaauucuacacgcuggccccuauggggaacggcaccggacggagacgcuga

SEQ ID NO: 29811 - RNA, 1617 nt, Artificial Sequence
  derived and/or modified sequence opt5 from VP1__Norovirus_and/or_Norovirus-like__AB972483
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaaaccaaucagaacacaaaauucacccccguuggggugauccaggauggaggcacaacgcaccggaaugagccccaacaguggguccucccuucuuacagcggccgcaacaccccgaaugugcaccuggcccccgcuguggccccuacauuucccggggaacagcuucuguucuuuagauccaccaugccuggauguagcggcuaucccaacauggaccucgauugccugcugccucaggaguggguucaauacuucuaucaggaggcggcucccgcccagucugacgucgcccuccugcgguuugugaauccggauacagggagagugcuuuucgaauguaagcugcauaaauccggauacgucaccguggcucacacgggccagcaugaccucguuauuccucccaacggguauuuucgcuucgauagcugggugaaccaauucuacacccuggccccuaugggcaauggaacaggccggagacgcuga

SEQ ID NO: 29812 - RNA, 1617 nt, Artificial Sequence
  derived and/or modified sequence opt5 from VP1__Norovirus_and/or_Norovirus-like__KP864106
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccgaucacgacuuugaagccaaccagaauaccaaauucacacccguuggggugauccaggauggaggcaccacacacagaaacgagccccaacaguggguccucccuagcuacuccggccggaauacgccgaacgugcaucuggcucccgccguggcgccuaccuuucccggggaacagcuucuguucuuucgcagcacaaugccuggauguucuggcuaucccaauauggaccucgauugccugcugccucaggaguggguucaauacuucuaucaggaggcugcccccgcccaguccgacgucgcucuccugagauuugugaacccggauaccgggcgggugcuuuucgaauguaagcugcacaaaagcggauacgucacaguggcccauaccggccagcacgaccucguuauuccucccaauggguauuuuagauucgauucuugggugaaccaauucuacacgcuggcuccuaugggcaacggaaccggccgccggagauga

SEQ ID NO: 29813 - RNA, 1617 nt, Artificial Sequence
  derived and/or modified sequence opt5 from VP1__Norovirus_and/or_Norovirus-like__KR904216
augaagauggccagcuccgacgcuaaccccucugauggcagcaccgccaaucuggcgccugaggugaacaaugaagucauggcucucgagccgguugugggggccgccaucgcugcccccguggcuggacagaaaaacgucauugacccuuggaucagaaauaacuucgugcaagcccccggcggggaauuuacaguuuccccucggaaugcgcccggagagauucuguggucugccccucuuggcccggaucugaaccccuaccucagccaccuggcucgcauguauaauggguacgccggaggcuucgaagugcaggucauccuugcuggcaacgccuuuacggcggggaagauuaucuucgccgcugugccucccaauuuuccuaccgagggacugucccccucucagguuacaauguucccgcauaucauuguggacgucagacagcucgagccugugcugaucccccugccugaugugcggaacaauuuuuaucacuacaaccaaagcaaugaccccaccauuaaacucaucgccaugcuguauacaccccuucgcgcuaacaacgccggcgaugacgucuucaccguuuccugcagagugcugacacggccuagcccggauuuugacuucauuuuucucgugcccccuaccgucgaaucucgcacgaagcccuucuccgccccugugcugaccguugaggaaaugacaaauagcagauuucccaucccgcuugagaaacuguucaccgggccuucuuccgcuuucgugguccagccccagaacggacgguguacaaccgauggcgugcuccuggggacgacacagcugagcccuguuaauauuugcaccuuucgcggagacgugacacauaucucuggcuccagaaacuacaccaugaaucucgcgagccaaaacuggaacuccuaugaucccaccgaggaaaucccugcuccccugggcacaccggacuucgucgggaagauucagggagugcuuacgcagaccacacggaccaauggcucuacacgcgggcacaaggccaccgucuacacgggaagcgccgacuuuuccccuaaacugggcagagugcaguucgccacagauaccgacaaugauuuugagaccaaccaaaauacaaaguucacccccguuggggugauccaggacggaagcacaacgccccggaacgaaccucagcaauggguccucccgucuuacuccggccgcaauacccauaacgugcaccuggcucccgccguugcgccuacauuucccggcgagcagcuucuguucuuuagaagcaccaugccuggguguucuggauaucccaauauggaucucgacugccugcugccucaggaaugggugcaguacuucuaucaagaggcugcccccgcccagagcgaugucgcucuccugcgguuugugaacccggacacaggcagagugcuuuucgaguguaaacugcacaaguccggguacguuaccgucgcccauacgggacagcgcgaucucgugauuccucccaacggcuauuuucgguucgacucuugggugaaucaguucuacagccuggcuccuauggggaacggcaccggaagacgccgguga

SEQ ID NO: 29814 - RNA, 1617 nt, Artificial Sequence
  derived and/or modified sequence opt5 from VP1__Norovirus_and/or_Norovirus-like__AB933771
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucaccggcucuagaaacuacaccaugaaucucgccucccagaacuggaauagcuaugaucccacagaggaaaucccugcuccccugggcacgccggacuucgucgggaaaauucagggagugcuuacccagacaacccggacaaacggcuccacccgcgggcacaaggcgacgguuuacacaggaucugccgacuuuagcccuaagcugggcagagugcaauucgcuaccgauaccgacaaugauuuugaggccaaccagaauacaaaauucacccccgucggggugauccaggacggauccacaacgccccggaacgaaccucaacaguggguucucccgagcuacucuggccgcaauauucauaacgugcaccuggcccccgcugucgccccuaccuuucccggcgagcagcuucuguucuuuagauccacaaugccuggguguagcggauaucccaauauggaucucgacugccugcugccucaggaaugggugcaauacuucuaucaggaggcggcucccgcccagucugauguggcccuccugcgguuuguuaacccggacaccggcagaguccuuuucgaguguaagcugcacaaaagcggguacgugacaguggcucauaccggacagcacgaucucgucaucccucccaacggcuauuuucgcuucgacuccugggugaaucaauucuacacgcuggccccuauggggaacggcaccggacggagacgcuga

SEQ ID NO: 29815 - RNA, 1617 nt, Artificial Sequence
  derived and/or modified sequence opt5 from VP1__Norovirus_and/or_Norovirus-like__LC005732
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucgggacuuugaagccaaucagaacaccaaauucacacccguuggggugauccaggauggaggcaccacacaucgcaaugagccccaacaguggguccucccuucuuacagcggcagaaacacgccgaaugugcaccuggcucccgccguggcgccuaccuuucccggggaacagcuucuguucuuucgguccacaaugccuggauguagcggcuaucccaacauggaccucgauugccugcugccucaggaguggguucaauacuucuaucaggaggcugcccccgcccagucugacgucgcucuccugagauuugugaauccggauaccgggcgcgugcuuuucgaauguaagcugcacaaauccggauacgccacagucgcucauaccggccagcacgaccucgugauuccucccaacggguauuuucgguucgauagcuggguuaaccaauucuacacgcuggccccuaugggcaauggaaccggcagacgccgguga

SEQ ID NO: 29816 - RNA, 1617 nt, Artificial Sequence
  derived and/or modified sequence opt5 from VP1__Norovirus_and/or_Norovirus-like__KP293591
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggaaugcuuacgcagaccacacgggccgacggcagcacccgcgggcacaaggcuacaguguacaccggauccgccaauuuugccccuaagcugggcagaguccaauucgagacggauacagaccaugauuuugaagcuaaccagaauaccaaauucacccccguggggguuauccaggacggaucuacaacccaccggaacgagccccaacagugggugcucccuagcuacuccggccgcaauacaccgaacguccaccuggcccccgcgguggcuccuacguuucccggcgaacagcuucuguucuuuagaagcaccaugccuggguguucuggauaucccaauauggaucucgacugccugcugccucaggagugggugcaauacuucuaucaggaggccgcccccgcucaguccgauguugcccuccugcgguuugucaacccggacacaggcagagugcuuuucgaauguaagcugcauaaaagcggguacgugaccgucgcucacacaggacagcaugaucucgugauuccucccaacggcuauuuucgcuucgacucuuggguuaaucaauucuacacccuggccccuauggggaacggcacgggacggagacgcuga

SEQ ID NO: 29817 - RNA, 1617 nt, Artificial Sequence
  derived and/or modified sequence opt5 from VP1__Norovirus_and/or_Norovirus-like__KP176396
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaaucgaaucucgcaccaaacccuucuccgugccuguccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggaauaacuaugaucccaccgaggaaaucccugcgccccugggcacaccggacuucguggggaaaauccagggaguucuuacgcagaccacacggaccgacggcagcacacgcgggcacaaggccaccguguacacgggauccgcugauuuuucuccuaagcugggcagaguccaauucgagacagacaccgaucaugacuuugaagccaaucagaacaccaaauucacacccguggggguuauucaggauggaggcaccacacaccggaaugagccccaacagugggugcucccuagcuacuccggccgcaacacgccgaauguccaccuggcccccgcuguggccccuaccuuucccggggaacagcuucuguucuuuagaagcacaaugccuggauguucuggcuaucccaacauggaccucgauugccugcugccucaggagugggugcaauacuucuaucaggaggcggcucccgcccaguccgacguugcccuccugcgguuugucaauccggauaccgggagagugcuuuucgaauguaagcugcauaaaagcggauacgugacagucgcucacaccggccagcaugaccucgugaucccucccaacggguauuuucgcuucgauucuuggguuaaccaauucuacacgcuggccccuaugggcaauggaaccggccggagacgcuga

SEQ ID NO: 29818 - RNA, 1617 nt, Artificial Sequence
  derived and/or modified sequence opt5 from VP1__Norovirus_and/or_Norovirus-like__KP176394
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccgcggaggaaauuccugcuccccugggcaccccggacuucguugggaaaauccagggagugcuuacacagacgaccagaacagacggcuccacccgggggcauaaggccacagucuacaccggaucugccgauuuugccccuaagcugggccgcgugcaauucgagacggacacagauagagacuuugaagcuaaccagaauaccaaauucacccccguuggggugauccaggauggaggcacaacccaccggaacgagccccaacaguggguccucccuagcuacuccggccgcaauacaccgaacgugcaccuggcccccgcgguggcuccuacguuucccggggaacagcuucuguucuuuagaagcaccaugccuggauguucuggcuaucccaauauggaccucgauugccugcugccucaggaguggguucaauacuucuaucaggaggccgcccccgcucaguccgacgucgcccuccugcgguuugugaacccggauacagggagagugcuuuucgaauguaagcugcauaaaagcggauacgucaccguggcucacacaggccagcaugaccucguuauuccucccaauggguauuuucgcuucgauucuugggugaaccaauucuacacccuggccccuaugggcaacggaacgggccggagacgcuga

SEQ ID NO: 29819 - RNA, 1617 nt, Artificial Sequence
  derived and/or modified sequence opt5 from VP1__Norovirus_and/or_Norovirus-like__KP096348
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccaaccacgauuuugacgccaaucagaacaccaaauucacacccguuggggugauccaggauggaggcaccacacacagaaaugaaccccaacaguggguccucccuagcuacuccggccggaacacgccgaaugugcaucuggcucccgccguggcgccuaccuuucccggggagcagcuucuguucuuucgcagcacaaugccuggauguucuggcuaucccaacauggaccucgauugccugcugccucaggaauggguucaauacuucuaucaggaggcugcccccgcccaguccgacgucgcucuccugagauuugugaauccggauaccgggcgggugcuuuucgaguguaagcugcacaaaagcggauacgucacaguggcccauaccggccagcacgaccucguuauuccucccaacggguauuuuagauucgauucuugggugaaccaauucuacacgcuggcuccuaugggcaauggaaccggccgccggagauga

SEQ ID NO: 29820 - RNA, 1617 nt, Artificial Sequence
  derived and/or modified sequence opt5 from VP1__Norovirus_and/or_Norovirus-like__KP096344
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcuccuaugaucccaccgaggaaauuccugcgccccugggcacaccggacuucguugggaaaauccagggaaugcuuacgcagaccacacggaccgacggcucuacacgcgggcacaaggccaccguguacacgggaagcgcugauuuugccccuaagcugggcagaguccaauucgagacagacaccgaucaugacuuugaagccaaucagaacaccaaauucacacccguggggguuauccaggauggauccaccacacaccggaaugagccccaacagugggugcucccuagcuacucuggccgcaacacgccgaauguccaccuggcucccgccguggcgccuaccuuucccggcgaacagcuucuguucuuuagauccacaaugccuggguguagcggauaucccaacauggaccucgauugccugcugccucaggagugggugcaauacuucuaucaggaggcugcccccgcccagucugacguugcucuccugcgguuugucaauccggauaccggcagagugcuuuucgaauguaagcugcauaaaagcggguacgugacagucgcccacaccggacagcaugaccucgugauuccucccaacggcuauuuucgcuucgauuccuggguuaaucaauucuacacgcuggcuccuauggggaacggcaccggacggagacgcuga

SEQ ID NO: 29821 - RNA, 1617 nt, Artificial Sequence
  derived and/or modified sequence opt5 from VP1__Norovirus_and/or_Norovirus-like__KM982946
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaaaccaaccagaauacaaaauucacccccguuggggugauccaggauggaggcacaacgcaucgcaacgagccccaacaguggguccucccuagcuacuccggcagaaauaccccgaacgugcaccuggcccccgcuguggccccuacauuucccggggaacagcuucuguucuuucggagcaccaugccuggauguucuggcuaucccaauauggaccucgauugccugcugccucaggaguggguucaauacuucuaucaggaggcggcucccgcccaguccgacgucgcccuccugagauuugugaacccggauacagggcgcgugcuuuucgaauguaagcugcacaaaagcggauacgucaccguggcucauacgggccagcacgaccucguuauuccucccaauggguauuuucgguucgauucuugggugaaccaauucuacacccuggccccuaugggcaacggaacaggcagacgccgguga

SEQ ID NO: 29822 - RNA, 1617 nt, Artificial Sequence
  derived and/or modified sequence opt5 from VP1__Norovirus_and/or_Norovirus-like__KM514070
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauguuacaggcucuagaaacuacaccaugaaucucgcuucccagaacuggagcaauuaugaucccaccgaggaaaucccugcgccccugggcacaccggacuucguggggaaaauucagggaguccuuacgcagaccacacggaccgacggcuccacacgcgggcacaaggccaccguguacacgggaucugcuaacuuugccccuaagcugggcagaguucaauucgagacagauaccgaccaugauuuugaagccaaucagaacaccaaauucacacccgugggggucauccaggacggaggcaccacacaccggaaugagccccaacagugggugcucccuagcuacuccggccgcaacacgccgaaugugcaccuggcucccgccguugcgccuaccuuucccggggaacagcuucuguucuuuagaagcacaaugccuggauguucuggcuaucccaacauggaucucgacugccugcugccucaggaguggguccaauacuucuaucaggaggcugcccccgcccaguccgauguggcucuccugcgguuugugaauccggacaccgggagaguccuuuucgaauguaagcugcauaaaagcggauacgugacaguugcccacaccggccagcaugaucucgugaucccucccaacggguauuuucgcuucgacucuugggucaaccaauucuacacgcuggcuccuaugggcaauggaaccggccggagacgcuga

SEQ ID NO: 29823 - RNA, 1617 nt, Artificial Sequence
  derived and/or modified sequence opt5 from VP1__Norovirus_and/or_Norovirus-like__KM514061
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccagaucauucuugcuggcaacgccuuuacagcggggaaagugaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaugaccccacaaucaagcucauugccaugcuguauacaccccuucgcgcuaacaacgccggcgaugacguguucaccguguccugcagaguccugacccggccuagcccggauuuugacuucaucuuucucgugcccccuacaguugaaucucgcaccaaacccuucuccgugccuguccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucucacaacuacaccaugaaucucgcuucccagaacuggagcaauuaugaucccaccgaggaaaucccugcgccccugggcacaccggacuucguggggaaaauccagggaguucuuacgcagaccacaagaaccgacggcuccacacgggggcauaaggccaccguguacacgggaucugcugauuuugccccuaagcugggccgcguccaauucgagacagacaccgauagagacuuugaagccaaccagaauaccaaauucacacccguggggguuauucaggauggaggcaccacacaccggaacgagccccaacagugggugcucccuagcuacuccggccgcaauacgccgaacguccaccuggcucccgccguggcgccuaccuuucccggggaacagcuucuguucuuuagaagcacaaugccuggauguucuggcuaucccaauauggaccucgauugccugcugccucaggagugggugcaauacuucuaucaggaggcugcccccgcccaguccgacguugcucuccugcgguuugucaacccggauaccgggagagugcuuuucgaauguaagcugcauaaaagcggauacgugacagucgcccacaccggccagcaugaccucgugaucccucccaauggguauuuucgcuucgauucuuggguuaaccaauucuacacgcuggcuccuaugggcaacggaaccggccggagacgcuga

SEQ ID NO: 29824 - RNA, 1617 nt, Artificial Sequence
  derived and/or modified sequence opt5 from VP1__Norovirus_and/or_Norovirus-like__KM514060
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuuucuccuaagcugggcagagugcaauucgagacagacaccgaucaugacuuugaagccaaucagaacaccaaauucacacccguuggggugauccaggauggaggcaccacacaccggaaugagccccaacaguggguccucccuagcuacuccggccgcaacacgccgaaugugcaccuggcccccgcuguggccccuaccuuucccggggaacagcuucuguucuuuagaagcacaaugccuggauguucuggcuaucccaacauggaccucgauugccugcugccucaggaguggguucaauacuucuaucaggaggcggcucccgcccaguccgacgucgcccuccugcgguuugugaauccggauaccgggagagugcuuuucgaauguaagcugcauaaaagcggauacgucacaguggcucacaccggccagcaugaccucguuauuccucccaacggguauuuucgcuucgauucuugggugaaccaauucuacacgcuggccccuaugggcaauggagcuggccggagacgcuga

SEQ ID NO: 29825 - RNA, 1617 nt, Artificial Sequence
  derived and/or modified sequence opt5 from VP1__Norovirus_and/or_Norovirus-like__KM268079
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaugaccccacaaucaagcucauugccaugcuguauacaccccuucgcgcuaacaacgccggcgaugacguguucaccguguccugcagaguccugacccggccuagcccggauuuugacuucaucuuucucgugcccccuacaguugaaucucgcaccaaacccuucuccgugccuguccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggagcaauuaugaucccaccgaggaaaucccugcgccccugggcacaccggacuucguggggaaaauccagggaguucuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauucaggauggaggcaccacacaccggaacgagccccaacagugggugcucccuagcuacuccggccgcaauacgccgaacguccaccuggcucccgccguggcgccuaccuuucccggggaacagcuucuguucuuuagaagcacaaugccuggauguucuggcuaucccaauauggaccucgauugccugcugccucaggagugggugcaauacuucuaucaggaggcugcccccgcccaguccgacguugcucuccugcgguuugucaacccggauaccgggagagugcuuuucgaauguaagcugcauaaaagcggauacgugacagucgcccacaccggccagcaugaccucgugaucccucccaauggguauuuucgcuucgauucuuggguuaaccaauucuacacgcuggcuccuaugggcaacggaaccggccggagacgcuga

SEQ ID NO: 29826 - RNA, 1617 nt, Artificial Sequence
  derived and/or modified sequence opt5 from VP1__Norovirus_and/or_Norovirus-like__KJ710247
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccgugcugacgaucgaggaaaugaccaacagcagauuuccuauuccccuugagaagcuguucacagggccgucuuccgccuucgucgugcagccucagaauggacgguguaccacagauggcguucuccuggggaccacgcaacugagccccgugaacaucugcacauuucgcggagacgucacccauaucacaggcucuagaaauuacaccaugaaccucgcuucccagaauuggaacaauuaugauccuaccgaggaaauucccgcgccucugggcacacccgacuucguggggaaaauccagggaaugcuuacgcagaccacacggaccgacggcagcacacgcgggcacaaggccaccgucuacacgggauccgcugauuuugccccgaagcugggcagagugcaauucgagacagacaccgaucaugacuuugaagccaaccagaauaccaaauucacaccuauugggguuauccaggauggaucuaccacacaccggaacgagccccaacagugggugcuccccagcuacuccggccgcaauacgcacaacguccaucuggcuccugccguggcgccgaccuuucccggcgaacagcuucuguucuuuagaagcacaaugccuggguguucuggauaucccaauauggaccucgauugccugcugccucaggaguggguucaauacuucuaucaggaggcugcccccgcccaguccgacguggcucuccugcgguuugucaacccugauaccggcagagugcuuuucgaauguaagcugcacaaaagcggguacgugacaguugcccauaccggacagcacgaccucgucauucccccgaacggcuauuuucgcuucgauucuugggugaaucaauucuacacgcuggcuccuauggggaacggcaccggacggagacgcuga

SEQ ID NO: 29827 - RNA, 1617 nt, Artificial Sequence
  derived and/or modified sequence opt5 from VP1__Norovirus_and/or_Norovirus-like__KJ685405
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccagacgauccuugccggcaacgcuuuuaccgccgggaaaauuaucuucgcggccgugccucccaauuuuccuacagagggacugucccccucucagguuaccauguucccgcauaucauuguggacgucagacaacucgagccugugcugaucccccugccugaugugcggaacaauuuuuaucacuacaaccagacaaaugaccccaccauuaagcucaucgcuaugcuguauacaccccuucgcgccaacaacgcuggcgaugacgucuucaccguuagcugcagagugcugacgcggccuuccccggauuuugacuucauuuuucucgugcccccuaccgucgaaagccgcacaaaacccuucucugugccuguucugaccguggaggaaaugacaaauuccagauuucccaucccgcuugagaagcuguucaccgggccuagcucugccuucgucgugcagccccagaacggacgguguacgacagauggcguucuccuggggaccacacaacuguccccugugaauauuugcaccuuucgcggagacgucacccauaucagcggcucuagaaacuacacaaugaaucucgccucccagaacuggaauagcuaugaucccacggaggaaaucccugcuccccugggcaccccggacuucguggggaaaauucagggaguccuuacacagaccacacggaccgacggcuccacgcgcgggcacaaggcgacaguguacaccggaucugccgauuuuagcccuaagcugggcagaguucaauucgcuaccgacacagauaacgacuuugagaccaaucagaacacaaaauucacgcccgugggggucauccaggauggaggcaccacacaucggaaugaaccccaacagugggugcucccuuccuacagcggccgcaacacccacaauguucaccuggccccggccguggcucccacauuuccuggggagcagcuucuguucuuuagaucuaccaugcccggauguuccggcuauccuaacauggaccucgauugccugcugccccaggaauggguccaauacuucuaucaggaggccgcgccugcucagagcgacguggcccuccugcgguuugugaaucccgauacggggagaguucuuuucgaguguaagcugcauaaaucuggauacgucaccguggcccacacaggccagcaugaccucgugauuccgccuaacggguauuuucgcuucgauagcugggucaaccaauucuacacccuggcucccaugggcaauggaacaggccggagacgcuga

SEQ ID NO: 29828 - RNA, 1617 nt, Artificial Sequence
  derived and/or modified sequence opt5 from VP1__Norovirus_and/or_Norovirus-like__KF429766
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucaucaaucagaacaccaaauucacacccguggggguuauucaggauggaagcaccacaccccggaaugagccucaacagugggugcucccgucuuacuccggccgcaacacgcauaauguccaccuggcccccgccguggcuccuaccuuucccggcgaacagcuucuguucuuuagaagcacaaugccuggguguucuggauaucccaacauggaccucgauugccugcugccucaggagugggugcaauacuucuaucaggaagccgcgcccgcucagagcgacguugcccuccugcgguuugucaauccggauaccggcagagugcuuuucgaguguaagcugcacaaauccggguacgugacagucgcccauaccggacagcacgaccucgugaucccucccaacggcuauuuucgcuucgauucuuggguuaaccaauucuacacgcuggcuccuauggggaauggcaccggacggagacgcuga

SEQ ID NO: 29829 - RNA, 1617 nt, Artificial Sequence
  derived and/or modified sequence opt5 from VP1__Norovirus_and/or_Norovirus-like__KF060009
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaugccaaucagaacaccaaauucacacccguuggggugauccaggacggaggcaccacacaccggaaugaaccccaacaguggguccucccuucuuacagcggccgcaacacgcacaaugugcaucuggcuccggccguggcgcccaccuuuccuggggagcagcuucuguucuuuagauccacaaugcccggauguagcggcuauccuaacauggaucucgacugccugcugccccaggaauggguucaauacuucuaucaggaggcugccccugcccagucugaugucgcucuccugcgguuugugaaucccgacaccgggagagugcuuuucgaguguaagcugcacaaauccggauacgucacaguggcccauaccggccagcacgaucucguuauuccgccuaacggguauuuucgcuucgacagcugggugaaccaauucuacacgcuggcucccaugggcaauggaaccggccggagacgcuga

SEQ ID NO: 29830 - RNA, 1617 nt, Artificial Sequence
  derived and/or modified sequence opt5 from VP1__Norovirus_and/or_Norovirus-like__KF059996
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacaaagaccaacggcuccacacgggggcacaaggcgaccguuuacacgggaucugccgacuuuagccccaaacugggccgcgugcaauucgcuacagauaccgacaaugauuuugagaccaaccagaauacaaaguucacccccgucggggugauccaggacggauccacaacgccuagaaacgaaccgcaacaguggguucuccccagcuacucuggccggaauauucauaacgugcaccuggccccugccgucgcucccaccuuuccuggcgagcagcuucuguucuuucgcuccacaaugcccggguguagcggauauccuaauauggaucucgacugccugcugccccaggaaugggugcaauacuucuaucaggaggccgcgccggcucagucugauguggcccuccugagauuuguuaacccugacaccggccggguccuuuucgaguguaaacugcacaagagcggguacgugacaguggcccauaccggacagcacgaucucgucauucccccuaacggcuauuuuagauucgacuccugggugaaucaauucuacacgcuggcucccauggggaacggcaccggacgccggagauga

SEQ ID NO: 29831 - RNA, 1617 nt, Artificial Sequence
  derived and/or modified sequence opt5 from VP1__Norovirus_and/or_Norovirus-like__HF952130
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgacagcaccauuaagcucaucgcuaugcuguauacaccccuucgcgccaauaacgcuggcgaugacguuuucaccgugucuugcagagugcugacacggcccuccccugauuuugacuucauuuuucucgucccgcccaccguggaaagccgcacgaaaccuuucucuguucccgugcugaccgucgaggaaaugacaaacuccagauuuccuaucccccuugagaagcuguucaccgggccgagcucugccuucgugguucagccucagaauggacgguguacaaccgauggcgugcuccuggggacgacacaacugucccccgucaacauuugcaccuuucgcggagacgugacacauaucagcggcuccagaaauuacaccaugaaccucgccucucagaauuggaacagcuaugauccuaccgaggaaauccccgcuccucugggcacacccgacuucgucgggaaaauucagggagugcuuacgcagaccacaaagaccaauggcuccacacgggggcacaaggcgaccguuuacacgggaagcgccgacuuuucuccgaaacugggccgcgugcaauucgcuacagauaccgacaacgauuuugagaccaaucagaacacaaaguucaccccugucggggugauccaggacggauccacaacgcccagaaaugaaccccaacaguggguucucccuagcuacucuggccggaacacccauaaugugcaccuggccccggccgucgcucccacauuuccuggcgagcagcuucuguucuuucgcagcaccaugcccggguguuccggauauccuaacauggaucucgacugccugcugccccaggaaugggugcaauacuucuaucaggaggccgcgccugcucagucugauguggcccuccugagauuuguuaaucccgacacaggccggguccuuuucgaguguaaacugcacaagagcggguacgugaccguggcccauacgggacagcacgaucucgucauuccgccuaacggcuauuuuagauucgacuccugggugaaccaauucuacacccuggcucccauggggaauggcacaggacgccggagauga

SEQ ID NO: 29832 - RNA, 1617 nt, Artificial Sequence
  derived and/or modified sequence opt5 from VP1__Norovirus_and/or_Norovirus-like__KC409302
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaucaaccagaauaccaaauucacacccgucggggugauucaggacggauccaccacaccucggaacgaaccgcaacaguggguucuccccagcuacucuggccgcaauauccauaacgugcaccuggccccugccgucgcucccacguuuccuggcgagcagcuucuguucuuuagauccaccaugcccggguguagcggauauccuaauauggaucucgacugccugcugccccaggaaugggugcaauacuucuaucaggaggccgcgccggcucagucugauguggcccuccugcgguuuguuaacccugacacaggcagaguccuuuucgaguguaagcugcacaaaagcggguacgugaccguggcccauacaggacagcacgaucucgucauucccccuaacggcuauuuucgcuucgacuccugggugaaucaauucuacacccuggcucccauggggaacggcacgggacggagacgcuga

SEQ ID NO: 29833 - RNA, 1617 nt, Artificial Sequence
  derived and/or modified sequence opt5 from VP1__Norovirus_and/or_Norovirus-like__JX459908
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaaugauuaugaccccaccgaggaaauuccugcgccccugggcacaccggacuucguugggaaaauccagggagugcuuacgcagaccacacggaccgauggcagcacacgcgggcacaaggccaccgucuacacgggauccgcugacuuugccccuaagcugggcagagugcaauucgagacagauaccgaccgggauuuugaagccaaccagaauaccaaauucacacccguuggggugauccaggacggaggcaccacacaucgcaacgagccccaacaguggguccucccuucuuacagcggcagaaauacgcacaacgugcaccuggcuccggccguggcgcccaccuuuccuggggaacagcuucuguucuuucgguccacaaugcccggauguagcggcuauccuaauauggaucucgacugccugcugccccaggaguggguucaauacuucuaucaggaggcugccccugcccagucugaugucgcucuccugagauuugugaaccccgacaccgggcgcgugcuuuucgaauguaagcugcauaaauccggauacgucacaguggcccacaccggccagcaugaucucguuauuccgccuaauggguauuuucgguucgacagcugggugaaccaauucuacacgcuggcucccaugggcaacggaaccggcagacgccgguga

SEQ ID NO: 29834 - RNA, 1617 nt, Artificial Sequence
  derived and/or modified sequence opt5 from VP1__Norovirus_and/or_Norovirus-like__JX445166
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucucacaacuacaccaugaaucucgccucccagaacuggaauagcuaugauccuaccgaggaaauccccgcuccgcugggcacaccugacuucgucgggaaaauucagggagugcuuacgcagaccacaagaaccaacggcuccacacgggggcauaaggcgaccguuuacacgggaucugccgacuuuagccccaagcugggccgcgugcaauucgcuacagauaccaauaacgacuuugagaccaaucagaacacaaaauucacccccgucggggugauccaggauggauccacaacgccuagaaaugaaccgcaacaguggguucuccccagcuacucuggccggaacacccacaaugugcaccuggccccugccgucgcucccacauuuccuggcgagcagcuucuguucuuucgcuccaccaugcccggguguagcggauauccuaacauggaccucgauugccugcugccccaggaaugggugcaauacuucuaucaggaggccgcgccggcucagucugacguggcccuccugagauuuguuaacccugauacaggccggguccuuuucgaguguaagcugcauaaaagcggguacgugaccguggcccacacgggacagcaugaccucgucauucccccuaauggcuauuuuagauucgauuccugggugaaccaauucuacacccuggcucccauggggaauggcacaggacgccggagauga

SEQ ID NO: 29835 - RNA, 1617 nt, Artificial Sequence
  derived and/or modified sequence opt5 from VP1__Norovirus_and/or_Norovirus-like__HQ693090
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuugcggugagcccucggaacgcccccggagagauucugugguccgcuccucuuggcccggaucugaaucccuaccucucucaccuggcccgcauguauaacggguacgcuggaggcuucgaaguccaggugauccuugccggcaaugcguuuaccgccgggaaaauuaucuucgcugccguuccucccaacuuuccuacagagggacugagccccucccaggugacgauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugccggcgaagauguuuucaccguguccugcagagugcugacacggcccagcccugacuuugauuucauuuuucucgucccgcccaccguggagucucgcacaaaaccuuucaccguucccauccugacgguggaagagaugaccaacuccagauuuccuauuccccuugagaagcuguucacagggccgagcggagcuuucgucgugcagccucagaauggccgguguaccacagacgggguucuccugggaaccacgcaacugucucccgugaacaucugcacauuucgcggcgaugucacccauaucgcgggcuccagaaauuacacaaugaaccucgccagccugaauuggaacaauuaugacccuaccgaagagauucccgcuccucuugggacccccgauuucgugggaaaaauccagggcguccugacacagacgaccaagggggacggaucuacacggggccacaaggccaccguguacacaggguccgccccguuuaccccuaaacucggaagcguucaguucuccacggacacagaaaacgauuuugagacccaucaaaauaccaaguucgcucccgugggcgucauucaggacggcucuacaacccaccgcaacgaaccccagcaaugggugcugccuagcuacuccgggggaaauguucacaacgugcaucuugccccggcggucgcucccacauuuccuggcgagcagcuccuguucuuuagaagcacgaugcccggguguucuggauauccuaauauggaucuggacugccugcucccccaggagugggugcagcacuucuaccaagaagccgccccugcucaguccgauguggcccugcuucgguuuguuaaccccgacaccggccgcguccuguucgaguguaaacuccauaagagcggguaugugacaguggcucacaccggccagcacgaucuggucaucccgccuaacggauacuuuagauucgacucuugggugaaucaguucuauacacuugcccccaugggcaacgggaccggacggagacgcuga

SEQ ID NO: 29836 - RNA, 1617 nt, Artificial Sequence
  derived and/or modified sequence opt5 from VP1__Norovirus_and/or_Norovirus-like__JN400611
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugaucucauuuuccuggucccgcccacaguggagucucgcaccaaaccuuuuacgguucccauccuuaccguggaagagaugacaaacuccagauucccuauuccccuggagaagcucuuuaccgggccgagcggagccuucgucgugcagccucagaauggccgguguacaaccgacgggguucugcugggaacgacacaacucucucccgugaacaucugcaccuuccgcggcgaugucacacauaucgcuggcuccagaaauuacaccaugaaccuggcgagccuuaauuggaacaauuaugacccuaccgaagagauucccgccccucuggggacacccgauuuugugggaaaaauccagggcguccucacgcagaccacaaagggggacggaucuacccggggccacaaggcuacaguguacaccgggggagccccguucacgccuaaacugggcuccguucaguuuagcacagacaccgaaaacgauuucgagacccaucaaaauacaaaguuuacccccgugggcgucauucaggacggguccacaacgcaccgcaacgaaccccagcaaugggugcuuccuucuuacagcggaagaaauguucacaacgugcaucuggccccggcugucgcccccaccuucccuggcgagcagcuccuguuuuuccgguccacaaugcccggguguagcggauauccuaauauggaucuggacugccuccugccccaggagugggugcagcacuuuuaccaagaagcggcuccugcccagucugauguggcccuucugcgcuucguuaaccccgacaccggcagaguccucuuugaguguaaacugcauaaguccggguaugugacaguggcucacaccggccagcacgaucuugucaucccgccuaacggauacuuccgguuugacagcugggugaaucaguucuauacgcuggcccccaugggcaacgggaccggaagacgccgguga

SEQ ID NO: 29837 - RNA, 1617 nt, Artificial Sequence
  derived and/or modified sequence opt5 from VP1__Norovirus_and/or_Norovirus-like__JN400609
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugggccccagccaggugaccauguucccgcauaucauugucgacgugagacaacucgagccugugcugaucccccugccugauguccggaauaacuuuuaucacuacaaucaguccaacgacucuacaauuaagcucaucgccaugcuguauacaccccuucgcgcuaacaaugccggggaagauguuuucaccgugagcugcagagugcugacccggcccuccccugacuuugauuucauuuuucucgucccgcccacaguggagagccgcaccaaaccuuucacgguucccauccugaccguggaagagaugacaaacucuagauuuccuauuccccuugagaagcuguucaccggaccguccggcgccuucgucgugcagccucagaaugggcgguguacaaccgacggaguucuccugggcacgacacaacugagccccgugaacaucugcaccuuucgcggcgaugucacacauaucgcugggucuagaaauuacaccaugaaccucgcgucccugaauuggaacaauuaugacccuaccgaagagauucccgccccucuuggaacacccgauuucgugggcaaaauccaggggguccugacgcagaccacaaagggagacggcagcacccgggggcacaaggcuacaguguacaccggaggcgccccguuuacgccuaaacucggcucuguucaguucuccacagacaccgaaaacgauuuugagacccaucaaaauacaaaguucacccccgugggggucauucaggacggaagcacaacgcaccgcaacgaaccccagcaaugggugcugccuuccuacucuggcagaaauguucacaacgugcaucuugccccggcugucgcccccaccuuuccuggggagcagcuccuguucuuucggagcacaaugcccggauguuccggcuauccuaauauggaucuggacugccugcucccccaggagugggugcagcacuucuaccaagaagcggcuccugcccagagcgauguggcccugcuucgcuuuguuaaccccgacaccgggagaguccuguucgaguguaaacuccauaagucuggcuaugugacaguggcucacaccggacagcacgaucuggucaucccgccuaacggcuacuuucgguucgacuccugggugaaucaguucuauacgcuugcccccauggggaacggaaccggcagacgccgguga

SEQ ID NO: 29838 - RNA, 1617 nt, Artificial Sequence
  derived and/or modified sequence opt5 from VP1__Norovirus_and/or_Norovirus-like__JQ613517
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgauccugugcugaucccccugccugacguccggaacaauuuuuaucacuacaaccaguccaaugaucccaccauuaagcucaucgcuaugcuguauacaccccuucgcgccaacaacgcuggagacgauguuuucaccgugagcugcagagugcugacacggccuucuccggacuuugauuucauuuuucucgugcccccuaccgucgagucccgcacgaaacccuucagcguuccuauccugaccguggaagagaugacaaauucuagauuucccauuccgcuugaaaagcuguucaccggcccuuccagcgccuucgucgugcagccccagaacgggcgguguacaaccgacggaguucuccugggcacgacacaacugucuccugugaauaucugcaccuuucgcggggaugucacacauaucgccggaacccaggaguacaccaugaaccucgcuucccagaauuggaacaauuaugaccccacagaggaaauuccugcgccccugggcacgccggacuucgugggcaaaauccaggggguccuuacccaaacaaccagaggagauggcagcacacgggggcacaaggccaccguguccacgggaucuguucauuuuacaccuaagcugggccgcauucaguucagcaccgacaccuccaacgauuuugagacagggcagaauaccagauucacacccgugggagucgugcaagacggcagcacgacccaccagaacgaaccccagcaguggguucucccuaauuacucuggccgggauucccacaacgugcaucuggcuccggccgucgcccccagcuuuccuggggagcaacuucuguucuuucgcucuacaaugcccggauguagcggcuacccuaauaugaaccucgacugccugcugccccaggaaugggugcagcacuucuaucaggaggcugccccugcgcaauccgauguggcucuccugagauuuguuaaucccgacaccgggcggguccuuuucgaguguaaacugcauaagucuggauacgugacaguggcccacaccggccagcacgaucucgucaucccgccuaacggguauuuuagauucgacagcugggugaaccaguucuacacgcuggcccccaugggcaauggaaccggccgccggagauga

SEQ ID NO: 29839 - RNA, 1617 nt, Artificial Sequence
  derived and/or modified sequence opt5 from VP1__Norovirus_and/or_Norovirus-like__JQ478409
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuaugugacaguggcucacaccgggcagcacgaucuggucaucccgccuaacggcuacuuucgguucgacucuugggugaaucaguucuauacgcuugcccccaugggaaacggcaccgggggaagacgcuga

SEQ ID NO: 29840 - RNA, 1617 nt, Artificial Sequence
  derived and/or modified sequence opt5 from VP1__Norovirus_and/or_Norovirus-like__GQ856460
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgacccgagcucugccuucgucgugcagccucagaaugggcgguguacaaccgauggaguucuccugggcacgacacaacugucccccgugaacaucugcaccuuucgcggggacgucacacauaucgcuggaagcagaaauuacaccaugaaccucgcgucucugaauuggaacaauuaugauccuaccgaagagauucccgccccucuuggcacacccgacuucgugggcaaaauccaggggguccugacgcagaccacaaagggagacggcuccacccgggggcacaaggcuacaguguacaccggaagcgccccguuuacgccuaaacucggcuccguucaguucucuacagauaccgaaaacgacuuugagacccaucaaaauacaaaguucacccccgugggggucauucaggauggaggcacaacgcaccgcaacgaaccccagcaaugggugcugccuagcuacuccggcagaaauguuccgaacgugcaccuugcccccgcugucgccccuaccuuucccggggagcagcuccuguucuuucggagcacaaugccuggauguucuggcuaucccaauauggaccuggauugcccucugccccaggagugggugcagcauuucuaccaagaagcggcuccggcccaguccgacguggcccuccugcgcuuuguuaacccugauaccgggagaguccuuuucgaguguaaacugcacaagagcggauaugugacaguggcucauaccggccagcacgaccucgucauucccccuaacggguacuuucgguucgauucuugggugaaucaguucuauacgcuggcccccaugggcaacggaaccggcagacgccgguga

SEQ ID NO: 29841 - RNA, 1617 nt, Artificial Sequence
  derived and/or modified sequence opt5 from VP1__Norovirus_and/or_Norovirus-like__GQ856449
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcacccacaauuacaccaugaaccucgcgagccugaauuggaacaauuaugacccuacagaagagauucccgccccucuuggcacgcccgauuucguggggaaaauccagggaguccugacccagacaaccaagggcgacgggucuacaagaggacauaaggcuaccguguacacgggcuccgccccguuuacaccuaaacucgggagcguucaguucuccaccgacaccgaaaacgauuuugagacacaccaaaauaccaaguucacacccgugggagucauucaggacggcucuacgacccaccggaacgaaccccagcaaugggugcugccuagcuacuccggcgggaauguucagaacgugcaucuugccccggcugucgcccccacauuuccuggagagcagcuccuguucuuucgcagcaccaugcccggcuguucuggguauccuaauauggaucuggacugccugcucccccaggagugggugcaacacuucuaccaggaagcggcuccugcccaguccgauguggcccugcuuagauuuguuaaccccgacacaggacggguccuguucgaguguaaacuccauaagagcggcuaugugaccguggcucacacggggcagcacgaucuggucaucccgccuaacggcuacucucgcuuugaccccugggugaaucaauucuauacccuugccccuaugggaaacggcacagggagacggagauga

SEQ ID NO: 29842 - RNA, 1617 nt, Artificial Sequence
  derived and/or modified sequence opt5 from VP1__Norovirus_and/or_Norovirus-like__EU921344
augaagauggccagcuccgacgcuacccccucugauggcagcacagccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacgguguccccucggaacgcccccggagagauucuguggucugcgccucuuggcccggaucugaaucccuaccucagccaccuggcccgcauguauaacggguacgcuggaggcuucgaaguccaggugauccuugccggcaaugcuuuuaccgccgggaaaauuaucuucgcggccguuccucccaacuuuccuacagagggacugucccccucucaggugaccauguucccgcauaucauugucgacgugagacaacucgagccugugcugaucccccugccugauguccggaauaacuuuuaucacuacaaucagagcaacgaccccacaauuaagcucaucgcuaugcuguauacaccccuucgcgccaauaacgcuggcgaugacguuuucaccguguccugcagagugcugacccggccuagcccggauuuugacuucauuuuucucgugcccccuacggucgaaucucgcaccaaacccuucuccguuccuauccugacaguggaggaaaugaccaacagcagauuucccauuccgcuugagaagcuguucacagggccuucuuccgccuucgucgugcagccccagaauggacgguguaccacggauggcguucuccuggggacaacccaacugagcccugugaacaucugcacauuucgcggagacgucacccauaucgccggcacccagaauuacacaaugaaccucgcuucucagaauuggaacaauuaugaucccacggaggaaauuccugcgccccugggcaccccggacuucguggggaaaauccagggaaugccuacacaaaccacaagaggcgacggguccacccggggacacaaggccacggucagcacaggcuccgugcauuuuacccccaagcuggggucuguucaguucagcaccgauacauccaacgacuuugagaccggacagaauacacgcuucacgcccgugggcgucgugcaagauggcagcaccacacaccagaacgaaccucagcaguggguucuuccgaauuacucugggagagacucccacaacgugcaucucgcucccgccgucgccccuaccuuucccggagagcaacugcuuuucuuucggagcacaaugccuggcuguucuggguaccccaauaugaaccuggauugccuccugccucaggaaugggugcagcacuucuaucaggagagcgcucccgcccaauccgacguggcgcugcuccgcuuuguuaauccggauaccggaagaguccuguucgaguguaaacuucauaagucuggcuacgugacgguggcucacaccgggcagcacgaccuggucauuccucccaacggcuauuuucgguucgauagcugggugaaccaguucuacacacucgccccuaugggaaauggcgccgggagacgccgguga

SEQ ID NO: 29843 - RNA, 1617 nt, Artificial Sequence
  derived and/or modified sequence opt5 from VP1__Norovirus_and/or_Norovirus-like__AB541290
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugguucuugcuggcaaugccuuuacagcggggaaaaucauuuucgccgcugugccucccaacuuuccuacggagggacugagccccucccaggucaccauguucccgcauaucaucguggacgugagacaacucgagccuguccugauuccccugccugauguucggaauaacuuuuaucacuacaaucagucuaacgacagcacaaucaagcucauugccaugcuguauacaccccuucgcgcuaacaaugccggcgaagauguguucaccguguccugcagaguccugacccggcccagcccugacuuugauuucaucuuucucgugccgcccacaguugagucucgcaccaaaccuuucacggugcccauucugaccgucgaagagaugacaaacuccagauuuccuaucccccuugagaagcuguucaccgggccgagcggagccuucgugguucagccucagaauggccgguguacaaccgacggggugcuccugggaacgacacaacugucucccgucaacauuugcaccuuucgcggcgaugugacacauaucgcuggcuccagaaauuacaccaugaaccucgcgagccugaauuggaacaauuaugacccuaccgaagagauccccgccccucuugggacacccgauuucgucggaaaaauucagggcgugcugacgcagaccacaaagggggacggaucuacccggggccacaaggcuacaguuuacaccggguccacgccguuuacaccuaaacucggaagcgugcaguucuccaccgacaccgaaaacgauuuugagaaucaucaaaacacaaaguucacccccgucggcgugauccaggacggcgggacaacgcaccgcaaugaaccccagcaauggguucugccuucuuacagcggaagaaacgugcagaauguccaccuugccccggccguggcucccaccuuuccuggcgagcagcuccuguucuuucgguccacaaugcccggguguagcggauauccuaacauggaucuggacugccugcucccccaggagugggugcaacauuucuaccaggaagccgcgccugcucagucugauguugcccugcuucgcuuugucaaccccgacaccggcagagugcuguucgaguguaaacuccacaaguccggguaugugacagucgcccauaccggccagcacgaucuggugauuccgccuaauggauacuuucgguucgacagcuggguuaaccaauucuauacgcuugcucccaugggcaaugggaccggaagacgccgguga

SEQ ID NO: 29844 - RNA, 1617 nt, Artificial Sequence
  derived and/or modified sequence opt5 from VP1__Norovirus_and/or_Norovirus-like__GQ845322
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcacgccguuuacaccuaaacucggauccguucaguucucuaccgacaccgaaaaugauuuugagacacaucaaaacaccaaguucacacccgugggcgucauucaggacggcagcacgacccaccgcaaugaaccccagcaaugggugcugccuuccuacagcgggagagauguucacaacgugcaucuugccccggccgucgcucccacauuuccuggagagcagcuccuguucuuucggucuaccaugcccggcuguuccggguauccuaauauggaccuggauugccugcucccccaggagugggugcagcacuucuaccaagaagccgcgccugcucagagcgacguggcccugcuucgcuuuguuaaccccgauacaggaagaguccuguucgaguguaaacuccauaagucuggcuaugugaccguggcccacacggggcagcacgaccuggucaucccgccuaauggcuacuuucgguucgauagcugggugaaccaguucuauacccuugcucccaugggaaacggcacagggagacgccgguga

SEQ ID NO: 29845 - RNA, 1617 nt, Artificial Sequence
  derived and/or modified sequence opt5 from VP1__Norovirus_and/or_Norovirus-like__AB220921
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaacaaauuucguucaggcucccggcggggaauuuacgguguccccucggaacgcccccggagagauucuguggucugcgccucuuggcccggaucugaaucccuaccucagccaccuggcccgcauguauaacggguacgcuggaggcuucgaaguccaggugauccuugccggcaaugcuuuuaccgccgggaaaauuaucuucgcggccguuccucccaacuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaacgcuggcgaugacguuuucaccgugagcugcagagugcugacccggcccucuccugauuuugacuucauuuuucucgucccgcccacgguggaaucccgcaccaaaccuuucacaguucccauccugaccguggaggaaaugacaaacagcagauuuccuauuccccuugagaagcuguucaccgggccgucuuccgccuucgucgugcagccucagaauggacgguguacgacagauggcguucuccuggggaccacacaacugagccccgugaacaucugcaccuuucgcggagacgucauccauauuccuggcaccagaacauaccggaugaaucucgccucucagaacuggaauaacuaugaucccacggaggaaaucccugcuccccugggcaccccggacuucguggggaaaauucagggaaugcuuacacagaccacaaagggcgacggguccacccgcggacacaaggcgacggucagcacaggcuccguggauuuuaccccuaaacuggggucuguucaauucgccaccgacacagauaaugacuuugagaccggacagaacacaagauucacgcccgugggcgucauccaggauggcagcuccgcucaucggaaugaaccccaacagugggugcucccugacuacagcgggcgcaccguucacaacgugcaccuggccccggccgucgcucccacauuuccuggagagcagcuucuguucuuuagaucuaccaugcccggcuguuccggguacccuaauauggaucucgacugccugcugccccaggaaugggugcaacauuucuaucaggaggccgcgccuagccagucugauguggcucuccugcgguuuguuaaccccgacacaggaagaguccuuuucgaguguaagcugcacaaagccggcuacgugaccguggcccauacggggcagcacgaucucgucauuccgccuaauggcuauuuucgcuucgacagcugggugaaccaauucuacacccuggcucccaugggaaauggcgccgggcggagacgcuga

SEQ ID NO: 29846 - RNA, 1617 nt, Artificial Sequence
  derived and/or modified sequence opt5 from VP1__Norovirus_and/or_Norovirus-like__KX514221
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaucccggcgaugacguuuucaccguguccugcagagugcugacccggccuagcccggauuuugacuucauuuuucucgugcccccuacagucgaaucucgcaccaaacccuucuccguuccuauccugacggugggggagaugaccaacagcagauuucccgucaaucuugaacggcuguucacaggaccgucuuccgccaacgugguucagccucagaauggccgcuguaccauugauggggagcuccugggaacaacccaacugagcucugugaacaucugcacguucagaggcgacgucacacauaucggcuccacccaccauuggacaaugaaucucgccagccccaacuggaauaacuacgauccuaccgaggaaauucccgcuccucuggggacccccgacuuugugggaaagauccagggcaugcuuacacagacgaccaaaggggagggauccacacggggccaccgcgcgaccgucuauguggggucugccaauuacgcuccgaagcugggaagaguucaguucgaaacagacaccacgaacgaucucgacgcccaccaaaauacaaaguuuaccccugugggcgucgugcagggcggggagagcccccagcgguccgaaccccaacaguggguucugccuagcuacucuggacgcgauaccccgaacgugcaucuugcccccgcugucgccccuacauuccccggcgagcagcugcucuuuuucagauccaccauuccuggguguggaggccaccccaauaugaaccuggacugccugcucccucaggagugggugcaacauuuuuaucaggaagcggcucccgcccagagcgauguggcccugcuucgguucguuaacccggacacaucuagaguccuguuugaguguaaacuccacaagagcggguacgugacgguggcucacaccggccagcaugaucuggucaucccucccaauggauauuuccgcuuugacuccugggugaaccaauucuacacacuugccccuaugggcaaugggaccggacggaaaagauga

SEQ ID NO: 29847 - RNA, 1617 nt, Artificial Sequence
  derived and/or modified sequence opt5 from VP1__Norovirus_and/or_Norovirus-like__KY486271
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggaaugcuuacgcagaccacacgggccgacggcagcacccgcgggcacaaggcuacaguguacaccggauccgccgauuuugccccuaagcugggcagaguccaauucgagacggacacagaucaugacuuugaagcuaaucagaacaccaaauucacccccguggggguuauccaggauggaucuacaacccaccggaaugagccccaacagugggugcucccuagcuacuccggccgcaacacacacaauguccaucuggccccggcgguggcucccacguuuccuggcgaacagcuucuguucuuuagaagcaccaugcccggguguucuggauauccuaacauggaccucgauugccugcugccccaggagugggugcaauacuucuaucaggaggccgccccugcucaguccgacguugcccuccugcgguuugucaaucccgauacaggcagagugcuuuucgaauguaagcugcacaaaagcggguacgugaccgucgcucauacaggacagcacgaccucgugauuccgccuaacggcuauuuucgcuucgauucuuggguuaaccaauucuacacccuggcccccauggggaauggcacgggacggagacgcuga

SEQ ID NO: 29848 - RNA, 1617 nt, Artificial Sequence
  derived and/or modified sequence opt5 from VP1__Norovirus_and/or_Norovirus-like__KP784692
augaagauggccagcuccgacgcuaaccccucugauggcagcaccgccaaucuggugccugaggucaacaaugaaguuauggcgcucgagccgguggugggggcugcccuggccgcucccgucgccggacagcaaaacgugaucgacccuuggauuagauccaauuucguucaggcucccggcggggaauuuacagugucuccucggaacgcccccggagagauccuuuggagcgcgccucugggcccggaucucaaucccuaccugucccaccuugcccgcauguauaacggguacgcuggaggcuucgaaguccaggugauucuggccggcaaugcuuuuacggccgggaaaguuaucuucgcggccgugccucccaacuuuccuaccgagggacucucucccagccaggucacaauguucccgcauauuaucguggacgugagacaacuggagccuguccugaucccccucccugauguucggaauaacuuuuaucacuacaaucaguccaacgaaagcaccauuaagcugaucgcuaugcuuuauacaccccugcgcgccaauaacgcuggcgacgauguguucaccgugucuugcagaguccucacacggcccuccccugacuuugauuucauuuuucuggugccgcccaccguugagagccgcacgaaaccuuucucugugcccauccuuaccgucgaagagaugacaaacuccagauuuccuauuccccuggagcggcuguucaccgggccgagcucugccuucgugguucagccucagaauggacgcuguacaaccgacggcgugcugcuggggacgacacaacucucccccgucaacaucugcaccuuuagaggagaugugacacauaccaccggcagccacaauuacacaaugaaccuggccucccagaauuggucuaacuaugacccuacggaagagauucccgcuccucuuggcacccccgauuucgucgggaagauccagggagugcugacacagaccacacgggcggacggcagcacccgcgggcauaaagccacgguuuacacaggauccgcugacuuuaccccgaagcucggcagagugcaauucgccaccgauacagaccacgauuuugacaccaaucagaacacaaaguucacgccugucggggugauccaggauggaagcaccacacaccggaaugaaccccaacaguggguucugcccucuuacuccggccgcaacacccauaaugugcaccuugccccugcugucgccccgacauuucccggcgagcagcuccucuucuuuagaagcaccaugccuggguguucuggauaucccaacauggaccuggauugccugcucccucaggaauggguggcgcauuucuaccaagaggcugcccccgcccagagcgacguggcucugcuucgguuuguuaauccugauacgggcagaguccuguucgaguguaaacuccacaaguccggguaugugaccguggcccacacaggacagcaugaccuggucauucccccgaacggcuacuuucgcuucgauucuugggugaaucaguucuauacccuugcuccuauggggaacggcacaggacggagacgcuga

SEQ ID NO: 29849 - RNA, 1617 nt, Artificial Sequence
  derived and/or modified sequence opt5 from VP1__Norovirus_and/or_Norovirus-like__KX371604
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuguuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuguccugaccguggaggaaaugacaaauagcagauuucccauuccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauuucuggcuccagaaacuacaccaugaaucucgccagccagaacuggaacuccuaugaucccaccgaggaaaucccugcuccccugggcacaccggacuucguggggaaaauccagggaguucuuacgcagaccacacggaccaauggcucuacacgcgggcacaaggcgaccguguacacgggaagcgccgacuuuuccccuaagcugggcagaguccaauucgcuacagauaccgacaaugauuuugagaccaaccagaauacaaaauucacccccguggggguuauucaggacggaagcacaacgccccggaacgaaccucaacagugggugcucccgucuuacuccggccgcaauauccauaacguccaccuggcccccgccauugcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucaucccucccaacggcuauuuucgcuucgacucuugggugaaucaauucuacacgcuggcuccuauggggaacggcaccggacggagacgcuga

SEQ ID NO: 29850 - RNA, 1617 nt, Artificial Sequence
  derived and/or modified sequence opt5 from VP1__Norovirus_and/or_Norovirus-like__KX354079
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaagucccugcuccccugggcacaccggacuucguggggaaaauccagggaguucuuacgcagaccacacggaccgacggcucuacacgcgggcacaaggcgaccguguacacgggaagcgccgauuuuuccccuaagcugggcagaguccaauucgcuacagacaccgauaaugacuuuguggccaaucagaacaccaaauucacacccguuggggugauucaggauggaagcaccacaccccggaaugagccucaacaguggguccucccgucuuacuccggccgcaacacgcauaaugugcaccuggcccccgcuguggccccuaccuuucccggcgaacagcuucuguucuuuagaagcacaaugccuggguguucuggauaucccaacauggaccucgauugccugcugccucaggaguggguucaauacuucuaucaggaagcggcucccgcccagagcgacgucgcccuccugcgguuugugaauccggauaccggcagagugcuuuucgaguguaagcugcacaaauccggguacgucacaguggcucauaccggacagcacgaccucguuaucccucccaacggcuauuuucgcuucgauucuugggugaaccaauucuacacgcuggccccuauggggagcggcaccggacggagacgcuga

SEQ ID NO: 29851 - RNA, 1617 nt, Artificial Sequence
  derived and/or modified sequence opt5 from VP1__Norovirus_and/or_Norovirus-like__KX354028
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucacagucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaaccccugcgccccugggcacgccggacuucguugggaaaauucagggagugcuuacccagacaacccggacagacggcagcacccgcgggcacaaggccacggucuacacaggauccgcugauuuugccccuaagcugggcagagugcaauucgagaccgacaccgaucaugacuuugaagccaaucagaacacaaaauucacccccguuggggugauccaggauggaucuacaacgcaccggaaugagccccaacaguggguccucccuagcuacuccggccgcaacacccacaaugugcaucuggcuccggccguggcgcccacauuuccuggcgaacagcuucuguucuuuagaagcaccaugcccggguguucuggauauccuaacauggaccucgauugccugcugccccaggaguggguucaauacuucuaucaggaggcugccccugcccaguccgacgucgcucuccugcgguuugugaaucccgauacaggcagagugcuuuucgaauguaagcugcacaaaagcggguacgucaccguggcccauacgggacagcacgaccucguuaucccgccuaacggcuauuuucgcuucgauucuugggugaaccaauucuacacccuggcucccauggggaauggcacaggacggagacgcuga

SEQ ID NO: 29852 - RNA, 1617 nt, Artificial Sequence
  derived and/or modified sequence opt5 from VP1__Norovirus_and/or_Norovirus-like__KX353983
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuguuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuguccugaccguggaggaaaugacaaauagcagauuucccauuccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauuucuggcuccagaaacuacaccaugaaucucgccagccagaacuggaacuccuaugaucccaccgaggaaaucccugcuccccugggcacaccggacuucguggggaaaauccagggaguucuuacgcagaccacacggaccgacggcucuacacgcgggcacaaggcgaccguguacacgggaagcgccgauuuuuccccuaagcugggcagaguccaauucgcuacagacaccgauaaugacuuugugaccaaucagaacacaaaauucacccccguuggggugauucaggauggaagcacaacgccccggaaugagccucaacaguggguccucccgucuuacuccggccgcaacacccauaaugugcaccuggcccccgccguggcuccuacauuucccggcgaacagcuucuguucuuuagaagcaccaugccuggguguucuggauaucccaacauggaccucgauugccugcugccucaggaguggguucaauacuucuaucaggaagccgcgcccgcucagagcgacgucgcccuccugcgguuugugaauccggauacaggcagagugcuuuucgaguguaagcugcacaaauccggguacgucaccguggcccauacgggacagcacgaccucguuaucccucccaacggcuauuuucgcuucgauucuugggugaaccaauucuacacccuggcuccuauggggaauggcacaggacggagacgcuga

SEQ ID NO: 29853 - RNA, 1617 nt, Artificial Sequence
  derived and/or modified sequence opt5 from VP1__Norovirus_and/or_Norovirus-like__AB972511
augaagauggccagcaacgacgcuaaucccuccgauggcccugccgcgaaccuggugccggaggucaauaacgaaguuauggcucucgagcccguggugggggccgccaucgcugccccugucgcuggacagcaaaaugugauugaccccuggaucagaaacaauuucguucaggccccuggcggggaauuuaccgugucuccccggaacgcgccuggagagauucuguggagcgccccgcuuggccccgaucugaauccuuaccucucccaccuggcucgcauguauaacggguacgccggaggcuucgaaguccaggugauccuugcuggcaaugccuuuacagcggggaaaauuaucuucgccgcuguucccccuaacuuucccacggagggacugucuccgagccaggugaccauguucccucauaucauugucgacgugagacaacucgagcccgugcugaucccucugcccgauguccggaauaacuuuuaucacuacaaucaguccaacgacucuacaauuaagcucaucgccaugcuguauacaccccuucgcgcuaacaaugccggcgaagauguuuucaccgugagcugcagagugcugacccggccuuccccggacuuugauuucauuuuucucgugcccccuacagucgagagccgcaccaaacccuucacgguuccuauccugaccguggaagagaugacaaacucuagauuucccauuccgcuugagaagcuguucaccgggccuuccagcgccuucgucgugcagccccagaauggacgguguacaaccgacggcguucuccuggggacgacacaacugucuccugugaacaucugcaccuuucgcggagaugucacacauaucgcuggcuccagaaauuacaccaugaaccucgcgagccugaauuggaacaauuaugaccccaccgaagagauuccugcuccccuuggcacaccggauuucguggggaaaauccagggaaugcugacgcagaccacaaagggcgacgggucuacccggggacacaaggccacagucuacaccggcuccgccccuuuuacgcccaaacucgggagcgugcaguucgaaacagacaccgagaacgauuuugaaacccaucaaaauacaaaguucacccccguuggagugauucaggacggcggcacaacgcaccgcaacgagccucagcaauggguccugccguccuacucugggagaaaugugcccaacguucaccuugccccugcuguggcccccaccuuuccuggagagcagcuccuguucuuucggagcaucaugcccggcuguuccggguauccuaauauggaucuggacugccugcucccccaggaauggguccagcauuucuaccaagaggcggcuccggcccagagcgauguggcccugcuucgcuuugugaacccugacacaggaagaguucuguucgaauguaaacuccacaagucuggcuaugucaccguggcucauacagggcagcacgaucuggugauucccccuaacggcuacuuucgguucgacuccugggucaaucaguucuauacccuugcccccaugggaaacggcacggggagacgccgguga

SEQ ID NO: 29854 - RNA, 1617 nt, Artificial Sequence
  derived and/or modified sequence opt5 from VP1__Norovirus_and/or_Norovirus-like__AB972478
augaagauggccagcuccgacgcuaaccccaccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaguuauuuucgccgcugugccucccaauuuuccuaccgagggacugagccccucccaggucacaauguucccgcauaucgugguggacgucagacaacucgagccuguucugaucccccugccugaugugcggaacaauuuuuaucacuacaaccagucuaaugaccccaccauuaagcucaucgccaugcuguauacaccccuucgcgcuaacaacgccggcgaugacguguucaccgucagcugcagagugcugacacggccuuccccggauuuugacuucauuuuucucguucccccuaccguggaaagccgcacgaaacccuucucugucccugugcugaccguugaggaaaugacaaauuccagauuucccaucccgcuugagaagcuguucaccgggccuagcucugccuucgugguccagccccagaacggacgguguacaaccgauggcgugcuccuggggacgacacaacuguccccugucaauauuugcaccuuucgcggagacgugacacauaucaccggcagcagaaacuacaccaugaaucucgcuucucagaacugguccaauuaugaucccacagaggaaauuccugcgccccugggcacgccggacuucguugggaaaauccagggagugcuuacccagacaacccggacagacggcagcacccgcgggcacaaggccacggucuacacaggauccgcugauuuugccccuaagcugggcagagugcaauucgagaccgacaccgaucaugacuuugaagccaaccagaauacaaaauucacccccguuggggugauccaggauggaucuacaacgcaccggaacgagccccaacaguggguccucccuagcuacuccggccgcaauaccccgaacgugcaccuggcucccgccguggcgccuacauuucccggcgaacagcuucuguucuuuagaagcaccaugccuggguguucuggauaucccaauauggaccucgauugccugcugccucaggaguggguucaauacuucuaucaggaggcugcccccgcccaguccgacgucgcucuccugcgguuugugaacccggauacaggcagagugcuuuucgaauguaagcugcauaaaagcggguacgucaccguggcccacacgggacagcaugaccucguuauuccucccaauggcuauuuucgcuucgauucuugggugaaccaauucuacacccuggcuccuauggggaacggcacaggacggagacgcuga

SEQ ID NO: 29855 - RNA, 1617 nt, Artificial Sequence
  derived and/or modified sequence opt5 from VP1__Norovirus_and/or_Norovirus-like__KT780382
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggaccucgauugccugcugccucaggaguggguucaauacuucuaucaggaggcugcccccgcccaguccgacgucgcucuccugcgguuugugaacccggauaccgggagagugcuuuucgaauguaagcugcauaaaagcggauacgucacaguggcccacaccggccagcaugaccucguuauuccucccaauggguauuuucgcuucgauucuugggugaaccaauucuacacgcuggcuccuaugggcaacggaaccggccggagacgcuga

SEQ ID NO: 29856 - RNA, 1617 nt, Artificial Sequence
  derived and/or modified sequence opt5 from VP1__Norovirus_and/or_Norovirus-like__KT033905
augaagauggccagcaacgacgcuaaucccuccgauggcucugccgcgaaccuggugccuaaagucaauaacgagguuauggcucucgaaccgguggugggggccgccaucgcugcccccgucgcuggacagcaaaaugugauugacccuuggaucagaaacaauuucguucaggcccccggcgggaaguuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgaaccugugcugaucccccugccugauguccggaauaacuuuuaucacuacaaucagucuaacgacagcacaauuaagcucaucgccaugcuguauacaccccuucgcgcuaacaaugccggcgaggauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugaaaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaggagauucccgccccucuugggacacccgauuucgugggaaagauccagggcguccugacgcagaccacaaaaggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcgggacaacgcaccgcaacgaaccccagcaaugggugcugccuucuuacagcggaagaaauguucacaacgugcaucuugccccggcugucgcccccaccuuuccuggcgagcagcuccuguucuuucgguccacaaugcccggguguagcggauauccuaauauggaucuggacugccugcucccccaggaaugggugcagcacuucuaccaagaggcggcuccugcccagucugauguggcccugcuucgcuuuguuaaccccgacaccggcagaguccuguucgaguguaaacuccauaaguccggguaugugacaguggcucacaccggccagcacgaucuggucaucccgccuaacggauacuuucgguucgacagcugggugaaucaguucuauacgcuugcccccaugggcaacgggaccggaagacgccgguga

SEQ ID NO: 29857 - RNA, 1617 nt, Artificial Sequence
  derived and/or modified sequence opt5 from VP1__Norovirus_and/or_Norovirus-like__KR904207
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccacauucgucgugcagccccagaacggacgguguaccacggauggcguucuccuggggacaacccaacugagcccugugaauaucugcacauuucgcggagacgucacccauaucgccggcucucacaacuacaccaugaaucucgccucccagaacuggaauagcuaugaucccacagaggaaauuccugcuccccugggcacgccggacuucguggggaaaauccagggaguccuuacccagacaaccagaacagacggcuccacccgggggcauaaggcgacgguguacacaggaucugccgauagcuccccuaagcugggccgcguucaauuugcuaccgacaccgauaacgacuucguggccaaucagaacacaaaauuuacccccgucggggugauucaggauggaggcacagcccacagaaaugagccccaacaguggguucucccuagcuacucuggccggaacacgcacaaugugcaucuggcuccggccgucgcgcccaccuucccuggggaacagcuucuguuuuuccgcuccacaaugcccggauguagcggcuauccuaacauggaccucgauugccugcugccccaggagugggugcaauacuuuuaucaggaagcugccccugcccagucugacguggcucuccugagauucguuaaucccgauaccgggcggguccuuuuugaguguaagcugcacaaaagcggauacgugacacaggcccauaccggccaacacgaccucgugaucccgccuaacggguauuucagauuugauuccugggucaaccaguucuacacgcuggcucccaugggcaauggaaccggccgccggagauga

SEQ ID NO: 29858 - RNA, 1617 nt, Artificial Sequence
  derived and/or modified sequence opt5 from VP1__Norovirus_and/or_Norovirus-like__KJ678151
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccacaccgcuugagaagcuguucaccgggccuucuuccgccuucgugguccagccccagaacggacgguguacaaccgauggcgugcuccuggggacgacacaacugagcccugucaauaucugcaccuuucgcggagacgugacacauauuaccggcucuagaaacuacaccaugaaucucgcuucccagaacuggagcaauuaugaucccacagaggaaaucccugcgccccugggcacgccggacuucguugggaaaauucagggagugcuuacccagacaacccggacagacggcuccacccgcgggcacaaggccacggucuacacaggaucugcugauuuugccccuaagcugggcagagugcaauucgagaccgacaccgaucaugacuuugaaacaaaccagaauaccaaauucacacccguuggggugauccaggauggaagcacgacccaccggaacgagccccaacaguggguccucccuuccuacagcggccgcaauacaccgaacgugcaccuggcccccgcuguggccccuaccuuucccggcgaacagcuucuguucuuuagaucuacaaugccuggguguuccggauaucccaauauggaccucgauugccugcugccucaggaguggguucaauacuucuaucaggaggcggcucccgcccagagcgacgucgcccuccugcgguuugugaacccggauaccggcagagugcuuuucgaauguaagcugcauaaaucuggguacgucacgguggcucacaccggacagcaugaccucguuaucccucccaauggcuauuuucgcuucgauagcugggugaaccaauucuacacacuggccccuauggggaacggcaccggacggagacgcuga

SEQ ID NO: 29859 - RNA, 1617 nt, Artificial Sequence
  derived and/or modified sequence opt5 from VP1__Norovirus_and/or_Norovirus-like__KJ678143
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccacaccgcuugagaagcuguucaccgggccuucuuccgccuucgugguccagccccagaacggacgguguacaaccgauggcgugcuccuggggacgacacaacugagcccugucaauaucugcaccuuucgcggagacgugacacauauuaccggcucuagaaacuacaccaugaaucucgcuucccagaacuggagcaauuaugaucccacagaggaaaucccugcgccccugggcacgccggacuucguugggaaaauucagggagugcuuacccagacaacccggacagacggcuccacccgcgggcacaaggccacggucuacacaggaucugcugauuuugccccuaagcugggcagagugcaauucgagaccgacaccgaucaugacuuugaagccaaccagaauacaaaauucacccccguuggggugauccaggauggaagcacaacgcaccggaacgagccccaacaguggguccucccuuccuacagcggccgcaauaccccgaacgugcaccuggcucccgccguggcgccuacauuucccggcgaacagcuucuguucuuuagaucuaccaugccuggguguuccggauaucccaauauggaccucgauugccugcugccucaggaguggguucaauacuucuaucaggaggcugcccccgcccagagcgacgucgcucuccugcgguuugugaacccggauacaggcagagugcuuuucgaauguaagcugcauaaaucuggguacgucaccguggcccacacgggacagcaugaccucguuaucccucccaauggcuauuuucgcuucgauagcugggugaaccaauucuacacccuggcuccuauggggaacggcacaggacggagacgcuga

SEQ ID NO: 29860 - RNA, 1617 nt, Artificial Sequence
  derived and/or modified sequence opt5 from VP1__Norovirus_and/or_Norovirus-like__KP698927
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugggaccaaccagaauacaaaauucacccccguuggagugauccaggauggcagcacaacgcaccggaacgaaccccaacaguggguccucccuuccuacagcggccgcaauaccccgaacgugcaccuggcccccgcuguggccccuacauuucccggggagcagcuucuguucuuuagaucuaccaugccuggauguuccggcuaucccaauauggaccucgauugccugcugccucaggaauggguucaauacuucuaucaggaggcggcucccgcccagagcgacgucgcccuccugcgguuugugaacccggauacagggagagugcuuuucgaguguaagcugcauaaaucuggauacgucaccguggcucacacgggccagcaugaccucguuauuccucccaauggguauuuucgcuucgauagcugggugaaccaauucuacacccuggccccuaugggcaacggaacaggccggagacgcuga

SEQ ID NO: 29861 - RNA, 1617 nt, Artificial Sequence
  derived and/or modified sequence opt5 from VP1__Norovirus_and/or_Norovirus-like__LC005730
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgcacaacgugcaucuggcuccggccguggcgcccaccuuuccuggggaacagcuucuguucuuuagaagcacaaugcccggauguucuggcuauccuaauauggaccucgauugccugcugccccaggaguggguucaauacuucuaucaggaggcugccccugcccaguccgacgucgcucuccugcgguuugugaaccccgauaccgggagagugcuuuucgaauguaagcugcacaaaagcggauacgucacaguggcccauaccggccagcacgaccucguuauuccgccuaauggguauuuucgcuucgauucuugggugaaccaauucuacacgcuggcucccaugggcaacggaaccggccggagacgcuga

SEQ ID NO: 29862 - RNA, 1617 nt, Artificial Sequence
  derived and/or modified sequence opt5 from VP1__Norovirus_and/or_Norovirus-like__LC005714
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaaugcugacgcagaccacaaagggcgacgggagcacccggggacacaaggcuacagucuacaccggcuccacgccguuuacaccuaaacucgggucugugcaguucagcaccgacaccgaaaaugauuuugagacacaucaaaacaccaaguucacacccguuggagugauucaggacggcuccacgacccaccgcaaugaaccccagcaauggguccugccuagcuacucuggcagaaacgugccgaauguucaccuugcccccgccguggcuccuacauuucccggggagcagcuccuguucuuucgguccaccaugccuggauguagcggcuaucccaacauggaucuggacugccugcucccucaggaguggguccagcauuucuaccaagaagccgcgcccgcucagucugauguggcccugcuucgcuuugugaauccggacacagggagaguucuguucgaguguaaacuccacaagagcggauaugucaccguggcccauacgggccagcacgaucuggugaucccucccaacggguacuuucgguucgacuccugggucaaccaguucuauacccuugcuccuaugggcaauggaacaggcagacgccgguga

SEQ ID NO: 29863 - RNA, 1617 nt, Artificial Sequence
  derived and/or modified sequence opt5 from VP1__Norovirus_and/or_Norovirus-like__KP241906
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcuaacuuugccccuaagcugggcagagugcaauucgagacagauaccgaccaugauuuugaagccaaucagaacaccaaauucacacccguuggggugauccaggacggaggcaccacacaccggaaugagccccaacaguggguccucccuagcuacuccggccgcaacacgccgaaugugcaccuggcucccgccguggcgccuaccuuucccggggaacagcuucuguucuuuagaagcacaaugccuggauguucuggcuaucccaacauggaucucgacugccugcugccucaggaguggguucaauacuucuaucaggaggcugcccccgcccaguccgaugucgcucuccugcgguuugugaauccggacaccgggagagugcuuuucgaauguaagcugcauaaaagcggauacgucacaguggcccacaccggccagcaugaucucguuauuccucccaacggguauuuucgcuucgacucuugggugaaccaauucuacacgcuggcuccuaugggcaauggaaccggccggagacgcuga

SEQ ID NO: 29864 - RNA, 1617 nt, Artificial Sequence
  derived and/or modified sequence opt5 from VP1__Norovirus_and/or_Norovirus-like__KM982938
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggccuccugcuggggaccacgcaacucagcccugugaauauuugcacauuucgcggagacgucacccauaucacaggcucuagaaacuacaccaugaaucuggcuucccagaacuggagcaauuaugaucccaccgaggaaauuccugcgccccuuggcacaccggacuucguggggaaaauccagggaguucugacgcagaccacacggaccgacggcuccacacgcgggcacaaggccaccguguacacgggaucugcugauuuugccccuaagcucggcagaguccaauucgagacagacaccgaucaugacuuugaagccaaccagaauaccaaauucacacccguggggguuauccaggauggaggcaccacacaccggaacgagccccaacagugggugcugccuagcuacuccggccgcaauacgccgaacguccaccuugcucccgccguggcgccuaccuuucccggggaacagcuccuguucuuuagaagcacaaugccuggauguucuggcuaucccaauauggaccuggauugccugcucccucaggagugggugcaauacuucuaucaggaggcugcccccgcccaguccgacguugcucugcuucgguuugucaacccggauaccgggagagugcuguucgaauguaagcuccauaaaagcggauacgugacagucgcccacaccggccagcaugaccuggugauuccucccaauggguauuuucgcuucgauucuuggguuaaccaauucuacacgcuugcuccuaugggcaacggaaccggccggagacgcuga

SEQ ID NO: 29865 - RNA, 1617 nt, Artificial Sequence
  derived and/or modified sequence opt5 from VP1__Norovirus_and/or_Norovirus-like__KM514058
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggccuccugcuggggaccacgcaacucagcccugugaauauuugcacauuucgcggagacgucacccauaucacaggcucuagaaacuacaccaugaaucuggcuucccagaacuggagcaauuaugaucccaccgaggaaauuccugcgccccuuggcacaccggacuucguggggaaaauccagggaguucugacgcagaccacacggaccgacggcuccacacgcgggcacaaggccaccguguacacgggaucugcugauuuugccccuaagcucggcagaguccaauucgagacagacaccgaucgggacuuugaagccaaccagaauaccaaauucacacccguggggguuauccaggauggaggcaccacacaucgcaacgagccccaacagugggugcugccuagcuacuccggcagaaauacgccgaacguccaccuugcucccgccguggcgccuaccuuucccggggaacagcuccuguucuuucggagcacaaugccuggauguucuggcuaucccaauauggaccuggauugccugcucccucaggagugggugcaauacuucuaucaggaggcugcccccgcccaguccgacguugcucugcuuagauuugucaacccggauaccgggcgcgugcuguucgaauguaagcuccacaaaagcggauacgugacagucgcccauaccggccagcacgaccuggugauuccucccaauggguauuuucgguucgauucuuggguuaaccaauucuacacgcuugcuccuaugggcaacggaaccggcagacgccgguga

SEQ ID NO: 29866 - RNA, 1617 nt, Artificial Sequence
  derived and/or modified sequence opt5 from VP1__Norovirus_and/or_Norovirus-like__KM198580
augaagauggccagcaacgacgcuaaucccaccgauggcuccgccgcgaaccuggugccugaggucucuaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagaccaaugacucuacaauuaagcucaucgccaugcuguauacaccccuucgcgcuaacaacgccggcgaagauguuuucaccgugagcugcagagugcugacccggcccuccccugacuuugauuucauuuuucucgucccgcccacgguggagagccgcaccaaaccuuucacaguucccauccugaccguggaagagaugacaaauucuagauuuccuauuccccuugagaagcuguucaccgggccguccggagccuucgucgugcagccucagaacggccgguguacgacagacgggguucuccugggaaccacacaacugagccccgugaauaucugcaccuuucgcggcgaugucacccauaucgcuggcucuagaaacuacacaaugaaucucgcgucccugaacuggaauaacuaugacccuacggaagagauucccgccccucuugggacccccgauuucgugggaaaaauccagggcguccugacacagaccacaaagggggacggaagcacccggggccacaaggcuacgguguacacagggucugccccguuuaccccuaaacucggauccguucaguucagcaccgacacagaaaaugauuuugagacccaucaaaacacaaaguucacgcccgugggcgucauucaggacggcgggaccacacaccgcaaugaaccccagcaaugggugcugccuuccuacucuggaagagauguucacaacgugcaucuugccccggcugucgcccccaccuuuccuggcgagcagcuccuguucuuucggagcacaaugcccggguguuccggauauccuaauauggaccuggauugccugcucccccaggagugggugcagcacuucuaccaagaagcggcuccugcccagagcgacguggcccugcuucgcuuuguuaaccccgauaccggcagaguccuguucgaguguaaacuccauaagucuggguaugugacgguggcucacaccggccagcacgaccuggucaucccgccuaauggauacuuucgguucgauuccugggugaaccaguucuauacacuugcccccaugggcaacgggaccggaagacgccgguga

SEQ ID NO: 29867 - RNA, 1617 nt, Artificial Sequence
  derived and/or modified sequence opt5 from VP1__Norovirus_and/or_Norovirus-like__KM198537
augaagauggcccccaacgacgcuaauccuagcgauggcuccgccgcgaaccuggugccggaggucucuaaugaaguuauggcucucgagcccguggugggggccgccaucgcugccccugucgcuggacagcaaaacgugauugaccccuggaucagaaauaacuucguucaggccccuggcggggaauuuaccgugagcccccggaaugcgccuggagagauucuguggggcgccccgcuugggcccgaucugaacccuuaccucucccaccuggcucgcauguauaauggauacgccggcggcuucgaaguccaggugauccuugcugggaacgccuuuacagcgggaaaaauuaucuucgccgcuguucccccuaauuuucccacggagggccugucuccgagccaggugaccauguucccucauaucauugucgacgugagacaacucgagcccgugcugaucccucugcccgauguccggaacaauuuuuaucacuacaaccagacaaaugacuccaccauuaagcucaucgccaugcuguauacaccccuucgcgcuaacaacgccggggaagauguuuucaccgugucuugcagagugcugacacggccuagcccggacuuugauuucauuuuucucgugcccccuaccgucgagucccgcacgaaacccuucaccguuccuauccugacaguggaagagaugaccaauagcagauuucccauuccgcuugagaagcuguucacaggaccuucuggcgccuucgucgugcagccccagaacgggcgguguaccacggacggaguucuccugggcacaacccaacuguccccugugaauaucugcacauuucgcggcgaugucacccauaucgcugggagcagaaacuacaccaugaaucucgcgucucugaacuggaauaacuaugaccccacagaagagauuccugcuccccuuggaacgccggauuucgugggcaaaauccaggggguccugacccagacaaccaagggagacggcuccacacgggggcacaaggccaccguguacacgggaagcgccccuuuuacacccaaacucggcucuguucaguucuccaccgacaccgaaaaugauuuugagacacaucaaaacaccaaguucacacccgugggcgucauucaggacgggggaacgacccaccgcaaugaaccucagcaaugggugcugccgagcuacuccggcagagauguucacaacgugcaucuugcccccgcugucgccccuacauuucccggggagcagcuccuguucuuucggucuaccaugccuggauguagcggcuaucccaauauggaccuggauugccugcucccucaggagugggugcagcacuucuaccaagaagcggcucccgcccaguccgacguggcccugcuucgcuuuguuaacccggauacagggagaguccuguucgaguguaaacuccauaagagcggcuaugugaccguggcucacaauggacagcacgaccuggucaucccucccaacggcuacuuucgguucgauucuugggugaaccaguucuauacgcuugccccuauggggaauggaaccggcagacgccgguga

SEQ ID NO: 29868 - RNA, 1617 nt, Artificial Sequence
  derived and/or modified sequence opt5 from VP1__Norovirus_and/or_Norovirus-like__KF177450
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugauuccccaggaguggguucaauacuucuaucaggaggcugccccugcccagucugacgucgcucugcuccgguuugugaaucccgauaccgggagagugcuguucgaauguaaacuucacaaguccggauacgucacaguggcccauaccggccagcacgaccugguuaucccgccuaacggguauuuucgcuucgauagcugggugaaccaauucuacacgcucgcucccaugggcaauggaaccggccggagacgcuga

SEQ ID NO: 29869 - RNA, 1617 nt, Artificial Sequence
  derived and/or modified sequence opt5 from VP1__Norovirus_and/or_Norovirus-like__KF008243
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccacagauuuugcuccuaagcugggcagagugcaauucgagaccgacaccgaucaugacuuugaagccaaucagaacacaaaauucacccccguuggggugauccaggauggaucuacaacgcaccggaaugagccccaacaguggguccucccuagcuacuccggccgcaacacccacaaugugcaucuggccccggcuguggcccccacauuuccuggcgaacagcuucuguucuuuagaagcaccaugcccggguguucuggauauccuaacauggaccucgauugccugcugccccaggaguggguucaauacuucuaucaggaggcggcuccugcccaguccgacgucgcccuccugcgguuugugaaucccgauacaggcagagugcuuuucgaauguaagcugcacaaaagcggguacgucaccguggcucauacgggacagcacgaccucguuauuccgccuaacggcuauuuucgcuucgauucuugggugaaccaauucuacacccuggcccccauggggaauggcacaggacggagacgcuga

SEQ ID NO: 29870 - RNA, 1617 nt, Artificial Sequence
  derived and/or modified sequence opt5 from VP1__Norovirus_and/or_Norovirus-like__KF429782
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccucugcugaucccccucccugaugugcggaacaauuuuuaucacuacaaccagagcaaugaccccaccauuaagcugaucgcuaugcuuuauacaccccugcgcgccaacaacgcuggcgaugacgucuucaccguuuccugcagagugcucacacggccuagcccggauuuugacuucauuuuucuggugcccccuaccgucgaaucucgcacgaaacccuucuccgugccuauccuuaccauugaggaaaugacaaauagcagauuucccaucccgcuggagaagcuguucaccgggccuucuuccgccuucguugugcagccccagaacggacgguguacaaccgauggcguccugcuggggacgacacaacucagcccugugaauaucugcaccuuucgcggagacguuacacauauuaccggcacccacaacuacgccaugaaucuggcugcgcagaacuggaacucuuaugaucccacagaggaaaucccugcuccccuuggcacgccggacuucguggggaaaauucagggaguccugacccagacaaccagagccgacggcuccacacgggcccauaaggccaccguguacacggggagcgcugaguuugccccuaagcucggacgcguccaauucgcgacagauaccgacuccgauuuugacaccaaucagaauacaaaauucacccccgugggcguuauccaggaugggaacacagcucaccaaaaugaaccccagcagugggugcugccuucuuacagcggaagaaacaaucacaacguccaucuugccccggccguggcucccacguuuccuggcgagcagcuccucuucuuucgguccaccaugcccggcuguagcggguauccuaauaugaaccuggacugccugcucccccaagaauggguucaguacuucuaucaggaggccgcuccugcccagucugauguggcgcugcuucgcuuugucaaccccgacacaggaagagugcuguucgaguguaagcuccacaaauccggcuacgugaccguugcccauacagggcaacacgaucuggucauuccgccuaauggauauuuucgguucgacagcugggugucucccuucuacacccuugcuccuaugggcaacgggacgggcagacgccgguga

SEQ ID NO: 29871 - RNA, 1617 nt, Artificial Sequence
  derived and/or modified sequence opt5 from VP1__Norovirus_and/or_Norovirus-like__KF060101
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacgggcggacggcucuacccgcgggcacaaggccacaguuuacaccggaagcgcugauuuuuccccuaagcugggcagagugcaauucgccacggacacagauaaugacuuugucgccaaucagaacaccaaauucacccccguggggguuauccaggauggaagcacaacaccccggaaugagccucaacagugggugcucccgucuuacuccggccgcaacacccauaauguccaccuggcucccgccguggcgccuacguuucccggcgaacagcuucuguucuuuagaagcaccaugccuggguguucuggauaucccaacauggaccucgauugccugcugccucaggagugggugcaauacuucuaucaggaagcugcccccgcccagagcgacguugcucuccugcgguuugucaauccggauacaggcagagugcuuuucgaguguaagcugcacaaauccggguacgugaccgucgcccauacaggacagcacgaccucgugauuccucccaacggcuauuuucgcuucgauucuuggguuaaccaauucuacacccuggcuccuauggggaauggcacgggacggagacgcuga

SEQ ID NO: 29872 - RNA, 1617 nt, Artificial Sequence
  derived and/or modified sequence opt5 from VP1__Norovirus_and/or_Norovirus-like__KF060096
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcuguguuugccccuaagcugggcagaguucaauucgagacagauaccgaccaugauuuugaagccaaccagaauaccaaauucacacccgugggggucauccaggacggaagcaccacacaccggaacgagccccaacagugggugcucccuuccuacagcggccgcaauacgccgaacgugcaccuggcucccgccguugcgccuaccuuucccggcgaacagcuucuguucuuuagaucuacaaugccuggguguuccggauaucccaauauggaucucgacugccugcugccucaggaguggguccaauacuucuaucaggaggcugcccccgcccagagcgauguggcucuccugcgguuugugaacccggacaccggcagaguccuuuucgaauguaagcugcauaaaucuggguacgugacaguugcccacaccggacagcaugaucucgugauuccucccaauggcuauuuucgcuucgacagcugggucaaccaauucuacacgcuggcuccuauggggaacggcaccggacggagacgcuga

SEQ ID NO: 29873 - RNA, 1617 nt, Artificial Sequence
  derived and/or modified sequence opt5 from VP1__Norovirus_and/or_Norovirus-like__KF060071
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgucagccagaacuggaacuccuaugaucccaccgaggaaaucccugcuccccugggcacaccggacuucguggggaaaauucagggaguucuuacgcagaccacacggaccaauggcucuacacgcgggcacaaggccaccguguacacgggaagcgcggacuuuuccccuaagcugggcagaguccaauucgccacagauaccgacaaugauuuugagaccaaccagaauacaaaauucacccccguggggguuauccaggacggaagcacaacgccccggaacgaaccucaacagugggugcucccgucuuacuccggccgcaauauucauaacguccaccuggcucccgccguggccccuaccuuucccggcgagcagcuucuguucuuuagaagcacaaugccuggguguucuggauaucccaauauggaucucgacugccugcugccucaggaaugggugcaauacuucuaucaggaggcugcccccgcgcagagcgauguugcucuccugcgguuugucaacccggacaccggcagagugcuuuucgaguguaagcugcacaaauccggguacgugacagucgcccauaccggacagcacgaucucgugaucccucccaacggcuauuuucgcuucgacucuuggguuaaucaauucuacacgcuggccccuauggggaacggcaccggacggagacgcuga

SEQ ID NO: 29874 - RNA, 1617 nt, Artificial Sequence
  derived and/or modified sequence opt5 from VP1__Norovirus_and/or_Norovirus-like__KF060056
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggaggcugccccugcccagucugacgucgcucuccugcgguuugugaaucccgauaccgggagagugcuuuucgaauguaagcugcacaaauccggauacgccacagucgcucauaccggccagcacgaccucgugauuccgccuaacggguauuuucgcuucgauagcuggguuaaccaauucuacacgcuggcccccaugggcaauggaaccggccggagacgcuga

SEQ ID NO: 29875 - RNA, 1617 nt, Artificial Sequence
  derived and/or modified sequence opt5 from VP1__Norovirus_and/or_Norovirus-like__JX439836
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgagccuuggcccugaucugaacccguaccucucccaccuggcccgcauguauaauggguacgcuggaggcuucgaaguccaggugauccuugccggcaacgcuuuuacggccgggaaaauuaucuucgcggccguucccccuaauuuucccaccgagggacugucuccuagccaggugacaauguucccccauaucauugucgacgugagacaacucgagccggugcugaucccucugcccgauguccggaacaauuuuuaucacuacaaccaguccaaugacccuaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucaucccucccaacggcuauuuucgcuucgacucuugggugaaucaauucuacacgcuggcuccuauggggaacggcaccggacggagacgcuga

SEQ ID NO: 29876 - RNA, 1617 nt, Artificial Sequence
  derived and/or modified sequence opt5 from VP1__Norovirus_and/or_Norovirus-like__HF952129
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauauccccggcucucacaacuacaccaugaaucucgccucccagaacuggaauagcuaugauccuaccgaggaaauucccgcuccgcugggcacaccugacuucguggggaaaauccagggaguccuuacgcagaccacaagaaccaacggcuccacacgggggcauaaggcgaccguguacacgggaucugccgacuuuagccccaagcugggccgcguucaauucgcuacagauaccgacaaugauuuugagaccaaccagaauacaaaauucacccccgugggggucauucaggacggauccacaacgccuagaaacgaaccgcaacagugggugcuccccagcuacucuggccggaauauccacaacguucaccuggccccugccguggcucccaccuuuccuggcgagcagcuucuguucuuucgcuccacaaugcccggguguagcggauauccuaauauggaucucgacugccugcugccccaggaauggguccaauacuucuaucaggaggccgcgccggcucagucugauguggcccuccugagauuugugaacccugacaccggccggguucuuuucgaguguaagcugcauaaaagcggguacgucacaguggcccacaccggacagcaugaucucgugauucccccuaacggcuauuuuagauucgacuccugggucaaucaauucuacacgcuggcucccauggggaacggcaccggacgccggagauga

SEQ ID NO: 29877 - RNA, 1617 nt, Artificial Sequence
  derived and/or modified sequence opt5 from VP1__Norovirus_and/or_Norovirus-like__KC409273
augaagauggccagcaacgacgcuaaucccuccgauggcucugccgcgagccuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucagacaaacgacuccaccauuaagcucaucgccaugcuguauacaccccuucgcgcuaauaacgccggcgaagauguuuucaccgugagcugcagagugcugacacggcccucuccugacuuugauuucauuuuucucgucccgcccaccguggagucccgcacgaaaccuuucaccguucccauccugacaguggaagagaugaccaacagcagauuuccuauuccccuugagaagcuguucacagggccgucuggagccuucgucgugcagccucagaauggccgguguaccacggacgggguucuccugggaacaacccaacugucccccgugaacaucugcacauuucgcggcgaugucacccauaucgcuggcagcagaaauuacaccaugaaccucgcgucucugaauuggaacaauuaugacccuacagaagagauucccgccccucuugggacgcccgauuucgugggaaaaauccagggcguccugacccagacaaccaagggggacggauccacacggggccacaaggcuaccguguacacggggagcgccccguuuacaccuaaacucggauccguucaguucucuaccgacaccgaaaacgauuuugagacacaucaaaauaccaaguucacacccgugggcgucauucaggacggcgggacgacccaccgcaacgaaccccagcaaugggugcugccuagcuacuccggaagagauguucacaaugugcaucuugccccggcugucgcccccacauuuccuggcgagcagcuccuguucuuucggagcaccaugcccggguguucuggauauccuaacauggaccuggauugccugcucccccaggagugggugcagcacuucuaccaagaagcggcuccugcccaguccgacgccgcucugcuucgcuuugugaaucccgauacaggcagaguucuguucgaguguaaacuccauaagagcggguaugucaccguggcccacacgggccagcacgaccuggugaucccgccuaacggauacuuucgguucgauucuugggucaaucaguucuauacccuugcucccaugggcaacgggacaggaagacgccgguga

SEQ ID NO: 29878 - RNA, 1617 nt, Artificial Sequence
  derived and/or modified sequence opt5 from VP1__Norovirus_and/or_Norovirus-like__KC409242
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauauccccggcuccagaaauuacaccaugaaccucgccagccagaauuggaacuccuaugauccuaccgaggaaauccccgcuccgcugggcacaccugacuucgucgggaaaauucagggagugcuuacgcagaccacacggaccaauggcucuacacgcgggcacaaggcgaccguuuacacgggaagcgccgacuuuucccccaagcugggcagagugcaauucgcuacagauaccgacaacgauuuugagaccaaucagaacacaaaauucacccccgucggggugauccaggacggaagcacaacgccucggaaugaaccgcaacaguggguucuccccucuuacuccggccgcaacauucauaaugugcaccuggccccugccgucgcucccaccuuuccuggcgagcagcuucuguucuuuagaagcacaaugcccggguguucuggauauccuaacauggaucucgacugccugcugccccaggaaugggugcaauacuucuaucaggaggccgcgccggcucagagcgauguggcccuccugcgguuuguuaauccugacaccggcagaguccuuuucgaguguaagcugcacaaauccggguacgugacaguggcccauaccggacagcacgaucucgucauucccccuaacggcuauuuucgcuucgacucuugggugaaccaauucuacacgcuggcucccauggggaauggcaccggacggagacgcuga

SEQ ID NO: 29879 - RNA, 1617 nt, Artificial Sequence
  derived and/or modified sequence opt5 from VP1__Norovirus_and/or_Norovirus-like__JX445167
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucucacaacuacaccaugaaucucgccucccagaacuggaauagcuaugauccuaccgaggaaguccccgcuccgcugggcacaccugacuucguggggaaaauccagggaguucuuacgcagaccacaagaaccaacggcuccacacgggggcauaaggcgaccguguacacgggaucugccgacuuuagccccaagcugggccgcguccaauucgcuacagauaccaauaacgacuuugagaccaaucagaacacaaaauucacccccguggggguuauucaggauggauccacaacgccuagaaaugaaccgcaacagugggugcuccccagcuacucuggccggaacacccacaauguccaccuggccccugccguggcucccacauuuccuggcgagcagcuucuguucuuucgcuccaccaugcccggguguagcggauauccuaacauggaccucgauugccugcugccccaggaaugggugcaauacuucuaucaggaggccgcgccggcucagucugacguugcccuccugagauuugucaacccugauacaggccgggugcuuuucgaguguaagcugcauaaaagcggguacgugaccgucgcccacacgggacagcaugaccucgugauucccccuaauggcuauuuuagauucgauuccuggguuaaccaauucuacacccuggcucccauggggaauggcacaggacgccggagauga

SEQ ID NO: 29880 - RNA, 1617 nt, Artificial Sequence
  derived and/or modified sequence opt5 from VP1__Norovirus_and/or_Norovirus-like__JX445156
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuuggagccaacaacgcuggcgaugacguuuucaccgugagcugccgcgugcugacaagaccuucuccggauuuugacuucauuuuucucgugcccccuaccgucgaaucccggacgaaacccuucagcguuccuauccugaccguggaggaaaugacaaauucucgcuuucccauuccgcuugagaagcuguucaccgggccuuccagcgccuucgucgugcagccccagaacggaagauguacaaccgauggcguucuccuggggacgacacaacugucuccugugaauaucugcaccuuucggggagacgucacacauaucgccggcacccaggaguacaccaugaaccucgcuucccagaauuggaacaauuaugaucccacagaagagauuccugcgccccugggcacgccggacuucguggggaaaauccagggaguccuuacccaaacaacccgcagagacggcagcacacgggggcacaaggccaccguguccacgggaucuguucauuuuacaccuaagcugggccgcauucaguucagcaccgauaccuccaacgacuuugaaacagggcagaauaccagauucacacccgugggagucgugcaagauggcagcacgacccaccagaacgagccccagcaguggguucucccuaauuacucuggccgggacucccacaacgugcaucuggcuccggccgucgcccccagcuuuccuggggaacaacuucuguucuuucgcucuacaaugcccggauguagcggcuacccuaauaugaaccucgauugccugcugccccaggagugggugcagcacuucuaucaggaggcugccccugcgcaauccgacguggcucuccugagauuuguuaaucccgauaccgggcggguccuuuucgaauguaaacugcauaagucuggauacgugacaguggcccacaccggccagcacgaccucgucaucccgccuaacggguauuuuagauucgauagcugggugaaccaguucuacacgcuggcccccaugggcaauggaaccggccgccggagauga

SEQ ID NO: 29881 - RNA, 1617 nt, Artificial Sequence
  derived and/or modified sequence opt5 from VP1__Norovirus_and/or_Norovirus-like__GQ856458
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugcccugacagcggggaaaauuaucuuugccgcuguuccucccaacuucccuacggagggacucagccccucccaggugaccauguuuccgcauaucauugucgacgugagacaacuggagccugugcugaucccccucccugauguccggaauaacuucuaucacuacaaucagucuaacgacagcacaauuaagcugaucgccaugcuuuauacaccccugcgcgcuaacaaugccggcgaagauguuuuuaccguguccugcagagugcucacccggcccagcccugacuucgauuuuauuuuccuggucccgcccacaguggagucucgcaccaaaccuuuuacgguucccauccuuaccguggaagagaugacaaacuccagauucccuauuccccuggagaagcucuuuaccgggccgagcucugccuucgucgugcagccucagaauggacgguguacaaccgacggcguucugcuggggacgacacaacucucccccgugaacaucugcaccuuccgcggagaugucacacauaucgcuggcagcagaaauuacaccaugaaccuggcgucucuuaauuggaacaauuaugacccuaccgaagagauucccgccccucugggcacacccgauuuuguggggaaaauccagggagucccgacgcagaccacaaagggcgacggguccacccggggacacaaggcuacaguguacaccggcagcgccccuuucacgcccaaacucggguccguucaguuuucuacagacaccgaaaacgauuucgaggcccaucaaaauaccaaguuuacacccgugggagucauucaggacggcggcaccacacaccgcaacgaaccucagcaaugggugcugccgagcuacuccgggagaaauguucccaacgugcaccuugcuccugccgucgcgcccacguucccuggagagcagcugcucuuuuuccggagcaccaugcccggcuguucuggguauccuaauauggaucuggacugccugcucccccaggagugggugcagcauuuuuaccaagaagcugccccggcccaguccgauguggcucugcuucgcuucguuaacccugacacaggaagaguccuguuugaguguaaacuccacaagagcggcuaugugaccguggcccauacagggcagcacgaucuggucauucccccuaacggcuacuuccgguuugacucuugggugaaucaguucuauacccuugcucccaugggaaacggcacggggagacgccgguga

SEQ ID NO: 29882 - RNA, 1617 nt, Artificial Sequence
  derived and/or modified sequence opt5 from VP1__Norovirus_and/or_Norovirus-like__AB541299
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcauagccuguauuuccggucuacaaugccuggcuguuccggguaccccaauauggaucucgacugccugcugccucaggagugggugcagcacuuuuaucaggaagcggcucccgcccaaagcgauguggcccuccugcgcuucguuaacccggacaccggaagaguccuuuuugaguguaaacugcauaagucuggcuacgugacaguggcucacaccgggcagcacgaucucgucaucccucccaacggcuauuuccgguuugacagcugggugaaucaguucuacacgcuggccccuaugggaaacggcaccgggagacgccgguga

SEQ ID NO: 29883 - RNA, 1617 nt, Artificial Sequence
  derived and/or modified sequence opt5 from VP1__Norovirus_and/or_Norovirus-like__AB541195
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcaugcugacgcagaccacaaagggggacggauccacccggggccacaaggcuacagucuacaccgggagcgccccguuuacgccuaaacucggaaaugugcaguucuccacagacaccgaaaacgauuuugagacccaucaaaauacaaaguucacccccguuggcgugauucaggacggcucuacaacgcaccgcaacgaaccccagcaauggguccugccuagcuacuccgggagagaugugcacaauguucaucuugccccggcuguggcccccaccuuuccuggagagcagcuccuguucuuucggagcacaaugcccggcuguucuggguauccuaacauggaccuggauugccugcucccccaggaguggguccagcacuucuaccaagaagcggcuccugcccaguccgacguggcccugcuucgcuuugugaaucccgauaccggaagaguucuguucgaguguaaacuccauaagagcggcuaugucacaguggcucacaccgggcagcacgaccuggugaucccgccuaacggcuacuuucgguucgauucuugggucaaccaguucuauacgcuugcccccaugggaaauggcaccgggagacgccgguga

SEQ ID NO: 29884 - RNA, 1617 nt, Artificial Sequence
  derived and/or modified sequence opt5 from VP1__Norovirus_and/or_Norovirus-like__AB504322
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagcucaacgacucuacaauuaagcugaucgccaugcuuuauacaccccugcgcgcuaacaaugccggcgaagauguuuucaccgugagcugcagagugcucacccggcccuccccugacuuugauuucauuuuucuggucccgcccacaguggagagccgcaccaaaccuuucacgguucccauccuuaccguggaagagaugacaaacucuagauuuccuauuccccuggagaaacucuucaccgggccguccggagccuucgucgugcagccucagaauggccgguguacaaccgacgggguucugcugggaacgacacaacucagccccgugaacaucugcaccuuucgcggcgaugucacacauaucgcuggcucuagaaauuacaccaugaaccuggcgucccuuaauuggaacaauuaugacccuaccgaagagauucccgccccucuggggacacccggauucgugggcaagauccaggggguccucacgcagaccacaaagggagauggcagcacccgggggcacaaggcuacaguguacaccggaucugccccguuuacgccuaaacugggcuccguucaguucagcacagacaccgaaaacgacuuugagacccaucaaaauacaaaguucacccccgugggcgucauucaggauggguccacaacgcaccgcaacgaaccccagcaaugggugcuuccuucuuacagcggaagaaauguucacaacgugcaucuggccccggcugucgcccccaccuuuccuggcgagcagcuccuguucuuucgguccacaaugcccggguguagcggauauccuaauauggaccuggauugccuccugccccaggagugggugcagcacuucuaccaagaagcggcuccugcccagucugacguggcccuucugcgcuuuguuaaccccgauaccggcagaguccucuucgaguguaaacugcauaaguccggguaugugacaguggcucacaccggccagcacgaccuugucaucccgccuaacggauacuuucgguucgauagcugggugaaucaguucuauacgcuggcccccaugggcaacgggaccggaagacgccgguga

SEQ ID NO: 29885 - RNA, 1617 nt, Artificial Sequence
  derived and/or modified sequence opt5 from VP1__Norovirus_and/or_Norovirus-like__EU876892
augaagauggccagcaacgacgcuaaucccuccgauggcucugccgcgaaccuggugcucgaggucaauaacgaaguuauggcucuggagccuguggugggggccgccaucgcugccccggucgcuggacagcaaaaugugaucgaccccuggaucagaaacaauuucguucaggccccuggcggggaauuuaccgugagcccccggaacgcgccuggagagauucuuugguccgcuccccugggcccugaucucaauccguaccugucucaccuugcccgcauguauaacggguacgccggaggcuucgaaguccaggugauccuggcuggcaaugccuuuacagcggggaaaauuaucuucgccgcuguucccccuaacuuucccacggagggacucagcccuucccaggugaccauguucccccauaucauugucgacgugagacaacuggagccggugcugaucccucuccccgauguccggaauaacuuuuaucacuacaaucagucuaacgacagcacaauuaagcugaucgccaugcuuuauaccccucugcgcgcuaacaaugccggcgaagauguuuucacaguguccugcagagugcucacccggcccagccccgacuuugauuucauuuuucuggucccuccgacaguggagucucgcaccaaacccuucacgguuccuauccuuaccguggaagagaugacaaacuccagauuucccauuccucuggagaaacucuucaccgggcccagcggagccuucgucgugcagccgcagaauggccgguguacaaccgacgggguucugcugggaacgacacaacucucuccugugaacaucugcaccuuucgcggcgaugucacacauaucgcuggcuccagaaauuacaccaugaaccuggcgagccuuaauuggaacaauuaugaccccaccgaagagauuccugcuccccuggggacaccugauuucgugggaaagauccagggcguccucacgcagaccacaaagggggacggaucuacccggggccacaaggccacaguguacaccggguccgcccccuuuacgccgaaacugggaagcguucaguucuccacagacaccgaaaacgauuuugagacccaucaaaauacaaaguucaccccugugggcgucauucaggacggcucuacaacgcaccgcaacgaaccccagcaaugggugcuucccagcuacuccgggagaaauguucacaacgugcaucuggccccugcugucgccccgaccuuucccggagagcagcuccuguucuuucggagcacaaugccuggcuguucuggguaucccaauauggaucuggacugccuccugccucaggagugggugcagcacuucuaccaagaagcggcucccgcccaguccgauguggcccuucugcgcuuuguuaacccugacaccggaagaguccucuucgaguguaaacugcauaagagcggcuaugugacaguggcucacaccgggcagcacgaucuugucauucccccgaacggcuacuuucgguucgacucuugggugaaucaguucuauacgcuggccccuaugggaaacggcaccgggagacgccgguga

SEQ ID NO: 29886 - RNA, 1617 nt, Artificial Sequence
  derived and/or modified sequence opt5 from VP1__Norovirus_and/or_Norovirus-like__EU876891
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaaaagaugacaaauagcagauuuccuauuccccuugagaaacuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaggaaauucccgccccucuugggacacccgauuucgugggaaagauccagggcguccugacgcagaccacaaagggggacggauccacccggggccacaaagcuacaguguacaccgggagcgccccguuuacgccuaagcucggauccguucaguucucuacagacaccgagaaugauuuugaaacccaucaaaacacaaaauucacccccgugggcgucauucaggacggcagcacaacgcaccgcaaugagccccagcaaugggugcugccuuccuacagcgggagaaacguucacaaugugcaucuugccccggcugucgcccccaccuuuccuggagaacagcuccuguucuuucggucuacaaugcccggcuguuccggguauccuaacauggaucuggacugccugcucccccaggagugggugcagcacuucuaccaagaggcggcuccugcccagagcgauguggcccugcuucgcuuuguuaaucccgacaccggaagaguccuguucgaauguaagcuccauaaaucuggcuaugugacaguggcucacaccgggcagcacgaucuggucaucccgccuaacggcuacuuucgguucgacagcugggugaaccaguucuauacgcuugcccccaugggaaauggcaccgggagacgccgguga

SEQ ID NO: 29887 - RNA, 1617 nt, Artificial Sequence
  derived and/or modified sequence opt5 from VP1__Norovirus_and/or_Norovirus-like__AB294792
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgacguccaggugauccuugccggcaacgcuuuuacggccgggaaaauuaucuucgcggccguuccucccaauuuuccuaccgaaggacugucccccucucaggugacaauguucccgcauaucauugucgaugugagacaacucgagccugugcugaucccccugccugacguccggaacaauuuuuaucacuacaaccagagcaaugauuccaccauuaagcucaucgcuaugcuguauacaccccuucgcgccaacaacgcuggcgacgauguuuucaccgugagcugcagagugcugacacggcccucuccugacuuugauuucauuuuucucgucccgcccaccguggagucccgcacgaaaccuuucaccguucccauccugacaguggaagagaugaccaauagcagauuuccuauuccccuugaaaagcuguucacagggccgucuuccgccuucgucgugcagccucagaacggacgguguaccacggacggcguucuccuggggacaacccaacugagccccgugaauaucugcacauuucgcggagaugucacccauaucccuggcaccagaacauaccggaugaaccucgccucucagaauuggaacaauuaugaccccacggaggagauuccugcuccccugggcaccccggacuucguggggaaaauccagggaaugcuuacacagaccacaaagggcgauggguccacccgcggacacaaggcgacggucagcacaggcuccguggacuuuaccccuaaacuggggucuguucaauucgccaccgauacagacaacgauuuugaaaccggacagaauacaagauucacgcccgugggcgucauucaggacggcagcuccacccaucggaacgagccccaacagugggugcucccugauuacagcgggcgcacaguucacaaugugcaccuggcuccggccgucgcccccaccuuuccuggagaacagcuucuguucuuuagaucuacaaugcccggcuguuccggguacccuaacauggaccucgauugccugcugccccaggagugggugcaacauuucuaucaggaagcugccccuagccagucugacguggcgcuccugcgguuuguuaaucccgauaccggaagaguccuuuucgaguguaagcugcacaaagcuggcuacgugacgguggcccauaccgggcagcacgaccucgucaucccgccuaacggcuauuuucgcuucgacagcugggugaaucaauucuacacacuggcccccaugggaaacggcgcugggcggagacgcuga

SEQ ID NO: 29888 - RNA, 1617 nt, Artificial Sequence
  derived and/or modified sequence opt5 from VP1__Norovirus_and/or_Norovirus-like__AB303932
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuguucaauucaacaccgauacaaauaacgacuuugaaaccggccagaauacaagauucacgcccgugggcgucgugcaggaugggaacggaacccaccaaaaugagccccagcaguggguucucccuuccuacagcggccggacagggcauaacgugcaccuggcuccggccgucgcccccaccuuuccuggagaacagcuucuguucuuucgcuccacaaugcccggcuguucuggguacccuaacaugaaucucgacugccugcugccccaagagugggugcagcauuucuaucaggaggcugccccugcgcagagcgauguggcucuccugagauuuguuaaccccgacaccggccggguccuuuucgaauguaagcugcacaaauccggauacgugacgguggcccacaccggccaacaugaucucgucauuccgccuaauggguauuuuagauucgacagcugggugaaccaguucuacacacuggcccccaugggaaauggcaccgggcgccggagauga

SEQ ID NO: 29889 - RNA, 1617 nt, Artificial Sequence
  derived and/or modified sequence opt5 from VP1__Norovirus_and/or_Norovirus-like__LC177660
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggaaugcuuacgcagaccacacggaccgacggcagcacacgcgggcacaaggccaccguguacacgggauccgcugauuuugccccuaagcugggcagaguccaauucgagacagacaccgaucaugacuuugaagccaaucagaacaccaaauucacacccguggggguuauccaggauggaucuaccacacaccggaaugagccccaacagugggugcucccuagcuacuccggccgcaacacgccgaauguccaccuggcucccgccguggcgccuaccuuucccggcgaacagcuucuguucuuuagaagcacaaugccuggguguucuggauaucccaacauggaccucgauugccugcugccucaggagugggugcaauacuucuaucaggaggcugcccccgcccaguccgacguugcucuccugcgguuugucaauccggauaccggcagagugcuuuucgaauguaagcugcauaaacucggguacgugacagucgcccacaccggacagcaugaccuggugauuccucccaacggcuauuuucgcuucgauagcuggguuaaccaauucuacacgcuugcuccuauggggaauggcaccggacggagacgcuga

SEQ ID NO: 29890 - RNA, 1617 nt, Artificial Sequence
  derived and/or modified sequence opt5 from VP1__Norovirus_and/or_Norovirus-like__KX608866
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucgccaaucagaacaccaaauucacacccguggggguuauccaggauggaagcaccacaccccggaaugagccucaacagugggugcucccgucuuacuccggccgcaacacgcauaauguccaccuggcccccgcuguggccccuaccuuucccggcgaacagcuucuguucuuuagaagcacaaugccuggguguucuggauaucccaacauggaccucgauugccugcugccucaggagugggugcaauacuucuaucaggaagcggcucccgcccagagcgacguugcccuccugcgguuugucaauccggauaccggcagagugcuuuucgaguguaagcugcacaaauccggguacgugacagucgcucauaccggacagcacgaccucgugauuccucccaacggcuauuuucgcuucgauucuuggguuaaccaauucuacacgcuggccccuauggggaauggcaccggacggagacgcuga

SEQ ID NO: 29891 - RNA, 1617 nt, Artificial Sequence
  derived and/or modified sequence opt5 from VP1__Norovirus_and/or_Norovirus-like__KX371603
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaaagcggguacgugacaguggcccauaccggacagcacgaucucgucauucccccuaacggcuauuuucgcuucgacuccugggugaaucaauucuacacgcuggcucccauggggaacggcaccggacggagacgcuga

SEQ ID NO: 29892 - RNA, 1617 nt, Artificial Sequence
  derived and/or modified sequence opt5 from VP1__Norovirus_and/or_Norovirus-like__KX354086
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaauuccugcuccccugggcacaccggacuucguggggaaaauccagggaguccuuacgcagaccacaucuaccaauggcagcacaagagggcauaaggcgaccguguacacgggauccgccgacuuuagcccuaagcugggccggguucaauucgcuacagauaccaaugacgauuuugagaccaaccagaauacaaaauucacccccgugggggucauucaggacggaucuacaacgccccgcaacgaaccucaacagugggugcucccguccuacagcggcagaaauacccacaacguucaccuggcccccgccguggcuccuacauuucccggcgagcagcuucuguucuuucggucuaccaugccuggguguagcggauaucccaauauggaucucgacugccugcugccucaggaauggguccaauacuucuaucaggaggccgcgcccgcucaguccgauguggcccuccugcgcuuugugaacccggacacaggcagaguucuuuucgaguguaagcugcauaaaucuggguacgucaccguggcccacacgggacagcaugaucucgugaucccucccaacggcuauuuucgguucgacagcugggucaaucaauucuacacccuggcuccuauggggaacggcacaggaagacgccgguga

SEQ ID NO: 29893 - RNA, 1617 nt, Artificial Sequence
  derived and/or modified sequence opt5 from VP1__Norovirus_and/or_Norovirus-like__KX354080
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucaccaaucagaacacaaaauucacccccguggggguuauccaggauggaagcacaacgccccggaaugagccucaacagugggugcucccgucuuacuccggccgcaacacccauaauguccaccuggcccccgccguggcuccuacauuucccggcgaacagcuucuguucuuuagaagcaccaugccuggguguucuggauaucccaacauggaccucgauugccugcugccucaggagugggugcaauacuucuaucaggaagccgcgcccgcucagagcgacguugcccuccugcgguuugucaauccggauacaggcagagugcuuuucgaguguaagcugcacaaauccggguacgugaccgucgcccauacgggacagcacgaccucgugauuccucccaacggcuauuuucgcuucgauucuuggguuaaccaauucuacacccuggcuccuauggggaauggcacaggacggagacgcuga

SEQ ID NO: 29894 - RNA, 1617 nt, Artificial Sequence
  derived and/or modified sequence opt5 from VP1__Norovirus_and/or_Norovirus-like__KX354054
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucaucccucccaacggcuauuuucgcuucgacucuugggugaaucaauucuacacgcuggcuccuauggggaacggcaccggacggagacgcuga

SEQ ID NO: 29895 - RNA, 1617 nt, Artificial Sequence
  derived and/or modified sequence opt5 from VP1__Norovirus_and/or_Norovirus-like__KX354041
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucucccugccuguucuuaccguggaggaaaugacaaauagcagauuucccaucccgcuggagaagcuguucaccgggccuucuuccgccuucgucgugcagccccagaacggacgguguacaaccgauggcguucugcuggggacgacacaacucagcccugugaauauuugcaccuuucgcggagacgucacacauaucucuggcuccagaaacuacaccaugaaucuggccagccagaacuggaacuccuaugaucccaccgaggaaaucccugcuccccuuggcacaccggacuucguggggaaaauucagggaguccugacgcagaccacacggaccaauggcucuacacgcgggcacaaggcgaccguguacacgggaagcguugacuuuuccccuaagcucggcagagugcaauucgccacagauaccgacaaugauuuugagaccaaccagaauacaaaauucacccccgucggggugauccaggacggaagcacaacgccccggaacgaaccucaacaguggguucugccgucuuacuccggccgcaauauucauaacgugcaccuugcucccgccgucgccccuaccuuucccggcgagcagcuccucuucuuuagaagcacaaugccuggguguucuggauaucccaauauggaucuggacugccugcucccucaggaaugggugcaauacuucuaucaggaggcugcccccgcgcagagcgauguggcucugcuucgguuuguuaacccggacaccggcagaguccuguucgaguguaagcuccacaaauccggguacgugacaguggcccauaccggacagcacgaucuggucaucccucccaacggcuauuuucgcuucgacucuugggugaaucaauucuacacgcuugccccuauggggaacggcaccggacggagacgcuga

SEQ ID NO: 29896 - RNA, 1617 nt, Artificial Sequence
  derived and/or modified sequence opt5 from VP1__Norovirus_and/or_Norovirus-like__KX354029
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucacagucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaaccccugcgccccugggcacgccggacuucguugggaaaauucagggagugcuuacccagacaacccggacagacggcagcacccgcgggcacaaggccacggucuacacaggauccgcugauuuugccccuaagcugggcagagugcaauucgagaccgacaccgaucaugacuuugaagccaaucagaacacaaaauucacccccguuggggugauccaggauggaucuacaacgcaccggaaugagccccaacaguggguccucccuagcuacuccggccgcaacacccacaaugugcaucuggcuccggccguggcgcccacauuuccuggcgaacagcuucuguucuuuagaagcaccaugcccggguguucuggauauccuaacauggaccucgauugccugcugccccaggaguggguucaauacuucuaucaggaggcugccccugcccaguccgacgucgcucuccugcgguuugugaaucccgauacaggcagagugcuuuucgaauguaagcugcacaaaagcggguacgucaccguggccuauacgggacagcaugaccucguuaucccgccuaacggcuacuuucgcuucgauucuugggugaaccaauucuauacccuggcucccauggggaauggcacaggacggagacgcuga

SEQ ID NO: 29897 - RNA, 1617 nt, Artificial Sequence
  derived and/or modified sequence opt5 from VP1__Norovirus_and/or_Norovirus-like__KX353977
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaggcacaacgccccggaacgaaccucaacaguggguucucccgagcuacucuggccgcaauauucauaacgugcaccuggcccccgccgucgcuccuaccuuucccggggagcagcuucuguucuuuagauccacaaugccuggauguagcggcuaucccaauauggaucucgacugccugcugccucaggaaugggugcaauacuucuaucaggaggccgcgcccgcucagucugauguggcccuccugcgguuuguuaacccggacaccgggagaguccuuuucgaguguaagcugcacaaaagcggauacgugacaguggcccauaccggccagcacgaucucgucaucccucccaacggguauuuucgcuucgacuccugggugaaucaauucuacacgcuggcuccuaugggcaacggaaccggccggagacgcuga

SEQ ID NO: 29898 - RNA, 1617 nt, Artificial Sequence
  derived and/or modified sequence opt5 from VP1__Norovirus_and/or_Norovirus-like__KX353965
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauacccccggcucucacaacuacaccaugaaucucgccucccagaacuggaauagcuaugauccuacagaggaaauccccgcuccgcugggcacgccugacuucgucgggaaaauccagggagugcuuacccagacaaccagaacaaacggcuccacccgggggcauaaggcgacgguuuacacaggaucugccgacuuuagccccaagcugggccgcgugcaauucgcuaccgauaccgacaaugauuuugagacaaaccagaauaccaaauucacacccgucggggugauucaggacggauccacgaccccuagaaacgaaccgcaacaguggguucuccccagcuacucuggccggaauauccacaacgugcaccuggccccugccgucgcucccacauuuccuggcgagcagcuucuguucuuucgcuccaccaugcccggguguagcggauauccuaauauggaucucgacugccugcugccccaggaaugggugcaauacuucuaucaggaggccgcgccggcucagucugauguggcccuccugagauuuguuaacccugacacaggccggguccuuuucgaguguaagcugcauaaaagcggguacgugaccguggcccacacgggacagcaugaucucgucauucccccuaacggcuauuuuagauucgacuccugggugaaucaauucuacacccuggcucccauggggaacggcacaggacgccggagauga

SEQ ID NO: 29899 - RNA, 1617 nt, Artificial Sequence
  derived and/or modified sequence opt5 from VP1__Norovirus_and/or_Norovirus-like__KU311158
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacgggccgacggcuccacccgcgggcacaaggcuacagucuacaccggaucugccgauuuugccccuaagcugggcagagugcaauucgagacggacacagaucaugacuuugaagcuaaccagaauaccaaauucacccccguuggggugauccaggauggaggcacaacccaccggaacgagccccaacaguggguccucccuagcuacuccggccgcaauacaccgaacgugcaccuggcccccgcgguggcuccuacguuucccggggaacagcuucuguucuuuagaagcaccaugccuggauguucuggcuaucccaauauggaccucgauugccugcugccucaggaguggguucaauacuucuaucaggaggccgcccccgcucaguccgacgucgcccuccugcgguuugugaacccggauacagggagagugcuuuucgaauguaagcugcauaaaagcggauacgucaccguggcucacacaggccagcaugaccucguuauuccucccaauggguauuuucgcuucgauucuugggugaaccaauucuacacccuggccccuaugggcaacggaacgggccggagacgcuga

SEQ ID NO: 29900 - RNA, 1617 nt, Artificial Sequence
  derived and/or modified sequence opt5 from VP1__Norovirus_and/or_Norovirus-like__AB974408
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugaccacacccucuccugacuuugauuucauuuuucucgucccgcccaccguggagucccggacgaaaccuuucaccguucccauccugacaguggaagagaugaccaauagccgcuuuccuauuccccuugagaagcuguucacagggccgucuuccgccuucgucgugcagccucagaacggaagauguaccacggacggcguucuccuggggacaacccaacugagccccgugaauaucugcacauuucggggagaugucacccauaucgcuggcucucgcaacuacaccaugaaucucgcgucccugaacuggaauaacuaugacccuacagaagagauucccgccccucuuggcacgcccgauuucguggggaaaauccagggaaugcugacccagacaaccaagggcgacgggagcacaagaggacacaaggcuaccgucuacacgggcuccgccccguuuacaccuaaacucgggucugugcaguucagcaccgacaccgaaaaugauuuugagacacaucaaaacaccaaguucacacccguuggagugauucaggacggcaauacgacccaccggaacgaaccccagcaauggguccugccuuccuacagcggccgcaaugugccgaacguucaccuugcccccgcuguggccccuacauuucccggggagcagcuccuguucuuuagaucuaccaugccuggauguuccggcuaucccaauauggaucuggacugccugcucccucaggaguggguccagcauuucuaccaagaagcggcucccgcccagagcgauguggcccugcuucgguuugugaacccggacacagggcgcguucuguucgaguguaaacuccacaagucuggauaugucaccguggcucauacgggccagcacgaucuggugaucccucccaacggguacuuuagauucgacagcugggucaaucaguucuauacccuugccccuaugggcaacggaacaggccggagacgcuga

SEQ ID NO: 29901 - RNA, 1617 nt, Artificial Sequence
  derived and/or modified sequence opt5 from VP1__Norovirus_and/or_Norovirus-like__KR904221
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcgccccggacuucguugggaaaauccagggaaugcuuacacagacgacccgggcugacggcagcacacgcgggcacaaggccaccguguacacaggauccgccgauuuugcuccuaagcugggcagaguccaauucgagaccgacacggaucaugacuuugaagccaaucagaacacaaaauucacccccguggggguuauccaggauggaucuaccacacaccggaaugagccccaacagugggugcucccuagcuacuccggccgcaacacccacaauguccaucuggcgccggcuguggcccccacauuuccuggcgaacagcuucuguucuuuagaagcacgaugcccggguguucuggauauccuaacauggaccucgauugccugcugccccaggagugggugcaauacuucuaucaggaggccgcuccugcccaguccgacguugcucuccugcgguuugucaaucccgauaccggcagagugcuuuucgaauguaagcugcacaaaagcggguacgugacagucgcccauaccggacagcacgaccucgugauuccgccuaacggcuauuuucgcuucgauucuuggguuaaccaauucuacacacuggcgcccauggggaauggcgccggacggagacgcuga

SEQ ID NO: 29902 - RNA, 1617 nt, Artificial Sequence
  derived and/or modified sequence opt5 from VP1__Norovirus_and/or_Norovirus-like__AB933765
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugaaccucuuggcccggaucugaaccccuaccucagccaccuggcgcgcauguauaauggguacgccggaggcuucgagguccaggugauccuugcuggcaacgccuuuacggcugggaaaauuaucuucgccgcgguuccucccaauuuuccuaccgagggacugucccccucucaggugacaauguucccgcauaucauugucgacgugagacaacucgaaccugugcugaucccccugccugauguccggaacaauuuuuaucacuacaaccagagcaaugacuccaccauuaagcucaucgccaugcuguauacaccccuucgcgcuaacaacgccggcgaugacguuuucaccgugagcugcagagugcugacacggcccucuccugauuuugacuucauuuuucucgucccgcccaccguggagucccgcacgaaaccuuucagcguucccgugcugaccgucgaagagaugacaaauucuagauuuccuaucccccuugagaagcuguucaccgggccguccagcgcuuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaagagaucccugcuccccugggcacaccggacuucgucgggaaaauucagggagugcuuacgcagaccacacggaccaauggcucuacacgcgggcacaaggccaccguuuacacgggaagcgcggacuuuuccccuaagcugggcagagugcaauucgccacagauaccgacaaugauuuugaaaccaaccagaauacaaaauucacccccgucggggugauccaggacggaggcacaacgcaucggaacgagccccaacaguggguucucccuagcuacucuggccgcaauauucacaacgugcaccuggcuccggccgucgcccccaccuuuccuggggaacagcuucuguucuuuagauccacaaugcccggauguagcggcuauccuaauauggaucucgacugccugcugccccaggagugggugcaauacuucuaucaggaggcugccccugcgcagucugauguggcucuccugcgguuuguuaaccccgacaccgggagaguccuuuucgaauguaagcugcauaaaagcggauacgugacaguggcccacaccggccagcaugaucucgucaucccgccuaacggguauuuucgcuucgacuccugggugaaucaauucuacacgcuggcccccaugggcaacggaaccggccggagacgcuga

SEQ ID NO: 29903 - RNA, 1617 nt, Artificial Sequence
  derived and/or modified sequence opt5 from VP1__Norovirus_and/or_Norovirus-like__AB933761
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaauuaauuucguucaggcucccggcggggaauuuacaguguccccucggaacgcccccggagagauccuguggucugcgccucuuggcccggaucugaaucccuaccucagccaccuggcccgcauguauaacggguacgcuggaggcuucgaaguccaggugauucuugccggcaaugcuuuuacggccgggaaaaucaucuucgcggccguuccucccaacuuuccuaccgagggacugucccccucucaggugacaauguucccgcauauuaucgucgacgugagacaacucgagccugugcugauuccccugccugauguccggaauaacuuuuaucacuacaaucagagcaacgaccccaccaucaagcucauugcuaugcuguauacaccccuucgcgccaauaacgcuggcgaugacguuuucaccguguccugcagagugcugacacggccuagcccggauuuugacuucaucuuucucgugcccccuaccgucgaaucucgcacgaaacccuucuccguuccugugcugaccgucgaggaaaugacaaacagcagauuucccauuccgcuugagaagcuguucaccgggccuucuuccgccuucgugguucagccccagaauggacgguguacaaccgauggcgugcuccuggggacgacacaacugagcccugucaacaucugcaccuuucgcggagacgugacacauauccccggcucuagaaauuacaccaugaaccucgccucccagaauuggaacagcuaugauccuaccgaggaaauucccgcuccgcugggcacaccugacuucgucgggaaaauccagggagugcuuacgcagaccacacggaccaauggcuccacacgcgggcacaaggcgaccguuuacacgggaucugccgacuuuagccccaagcugggcagagugcaauucgcuacagauaccgacaacgauuuugagaccaaucagaacacaaaauucacccccgucggggugauucaggacggauccacaacgccucggaaugaaccgcaacaguggguucuccccagcuacucuggccgcaacauccauaaugugcaccuggccccugccgucgcucccaccuuuccuggcgagcagcuucuguucuuuagauccacaaugcccggguguagcggauauccuaacauggaucucgacugccugcugccccaggaaugggugcaauacuucuaucaggaggccgcgccggcucagucugauguggcccuccugcgguuuguuaauccugacaccggcagaguccuuuucgaguguaagcugcacaaaagcggguacgugacaguggcccauaccggacagcacgaucucgucauucccccuaacggcuauuuucgcuucgacuccugggugaaccaauucuacacgcuggcucccauggggaauggcaccggacggagacgcuga

SEQ ID NO: 29904 - RNA, 1617 nt, Artificial Sequence
  derived and/or modified sequence opt5 from VP1__Norovirus_and/or_Norovirus-like__AB933748
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucuggcacgcuugggccugaucugaacccguaccucagccaccuggcgcgcauguauaauggauacgccggcggcuucgaaguccaggugauccuugcugggaacgccuuuaccgcuggaaaaauuaucuucgccgcgguucccccuaauuuucccacagagggccuguccccuucucaggugaccauguucccccauaucauugucgacgugagacaacucgagccggugcugaucccucugcccgauguccggaacaauuuuuaucacuacaaccagagcaaugacccuacaauuaagcucaucgccaugcuguauacaccccuucgcgcuaacaacgccggggaugacguuuucaccguguccugcagagugcugacccggcccagcccugauuuugacuucauuuuucucgucccgcccacgguggaaucucgcaccaaaccuuucuccguucccgugcugacagucgaggaaaugaccaauagcagauuuccuaucccccuugagaagcuguucacaggaccgucuuccgcuuucgugguucagccucagaacggccgguguaccacggauggggugcuccugggaacaacccaacugagccccgucaauauuugcacauuucgcggcgacgugacccauaucccuggcucuagaaacuacaccaugaaucucgccucccagaacuggaauagcuaugaucccacagaggaaaucccugcuccccuggggacgccggacuucgucggaaaaauucagggcgugcuuacccagacaacccggacaaacggguccacccgcggacacaaggccacgguuuacacaggcucugcggacuuuagcccuaagcuggggagagugcaauucgccaccgauaccgacaaugauuuugagacaaaccagaauaccaaauucacacccgucggagugauccaggacggcuccacgacaccccggaacgaaccucaacaguggguucucccgagcuacucuggccgcaauauucauaacgugcaccuggcucccgccgucgccccuaccuuucccggggagcagcuucuguucuuuagauccaccaugccuggauguagcggcuaucccaauauggaucucgacugccugcugccucaggaaugggugcaauacuucuaucaggaggcugcccccgcgcagucugauguggcucuccugcgguuuguuaacccggacacagggagaguccuuuucgaguguaagcugcacaaaagcggauacgugaccguggcccauacgggccagcacgaucucgucaucccucccaacggguauuuucgcuucgacuccugggugaaucaauucuacacccuggccccuaugggcaacggaacaggccggagacgcuga

SEQ ID NO: 29905 - RNA, 1617 nt, Artificial Sequence
  derived and/or modified sequence opt5 from VP1__Norovirus_and/or_Norovirus-like__EU921386
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucauccauauugcuggcagcagaaacuacacaaugaaucucgcgucucugaacuggaauaacuaugacccuaccgaagagauccccgccccucuugggacccccgauuucgugggaaaaauucagggcguccugacacagacgaccaagggggacggauccacacggggccacaaggcuaccguguacacagggagcgccccguuuaccccuaaacucggauccguucaguucucuacggacacagaaaaugauuuugaggcccaucaaaacaccaaguucacccccgugggcgucauccaggacggcgggacaacccaccgcaaugaaccccagcaaugggugcugccuagcuacuccggaagaaacguucacaaugugcaucuugcuccggccgucgcgcccacauuuccuggcgagcagcuccuguucuuucggagcacgaugcccggguguucuggauauccuaacauggaucuggacugccugcucccccaggagugggugcagcacuucuaccaagaagcugccccugcccaguccgauguggcucugcuucgcuuuguuaaucccgacaccggcagaguccuguucgaguguaaacuccauaagagcggguaugugacaguggcccacaccggccagcacgaucuggucauuccgccuaacggauacuuucgguucgacucuugggugaaccaguucuauacacuugcucccaugggcaaugggaccggaagacgccgguga

SEQ ID NO: 29906 - RNA, 1617 nt, Artificial Sequence
  derived and/or modified sequence opt5 from VP1__Norovirus_and/or_Norovirus-like__KP244321
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggaugcucccgucuuacuccggccgcaauacccauaacguucaccuggcccccgccguggcuccuacauuucccggcgagcagcuucuguucuuuagaagcaccaugccuggguguucuggauaucccaauauggaucucgacugccugcugccucaggaauggguccaauacuucuaucaggaggccgcgcccgcucagagcgauguggcccuccugcgguuugugaacccggacacaggcagaguucuuuucgaguguaagcugcacaaauccggguacgucaccguggcccauacgggacagcacgaucucgugauuccucccaacggcuauuuucgcuucgacucuugggucaaucaauucuacacccuggcuccuauggggaacggcacaggacggagacgcuga

SEQ ID NO: 29907 - RNA, 1617 nt, Artificial Sequence
  derived and/or modified sequence opt5 from VP1__Norovirus_and/or_Norovirus-like__KP698923
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccaaccacgauuuugaagccaaucagaacaccaaauucacacccguuggggugauccaggacggaggcaccacacacagaaaugagccccaacaguggguccucccuagcuacuccggccggaacacgccgaaugugcaucuggcucccgccgcggcuccuaccuuucccggggaacagcuucuguucuuucgcagcacaaugccuggauguucuggcuaucccaacauggaucucgacugccugcugccucaggagugggugcaauacuucuaucaggaggccgcccccgcucaguccgauguugcccuccugagauuugucaauccggacaccgggcgggugcuuuucgaauguaagcugcacaaaagcggauacgugacagucgcucauaccggccagcacgaucucgugauuccucccaacggguauuuuagauucgacucuuggguuaaccaauucuacacgcuggccccuaugggcaauggaaccggccgccggagauga

SEQ ID NO: 29908 - RNA, 1617 nt, Artificial Sequence
  derived and/or modified sequence opt5 from VP1__Norovirus_and/or_Norovirus-like__KP241905
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucagagugauccuugcuggcaacgccuuuacagcggggaaaguuauuuucgccgcugugccucccaauuuuccuacggagggacugucccccucucaggucaccauguucccgcauaucgugguggacguccggcagcucgagccuguucugaucccccugccugaugugcgcaacaauuuuuaucacuacaaccaaagcaaugaccccacaauuaagcucaucgccaugcuguauacaccccuuagagcuaacaacgccggcgaugacguguucaccgucuccugccgggugcugacccgcccuagcccggauuuugacuucauuuuucucguucccccuacaguggaaucuagaaccaaacccuucuccgucccuauccugacgguggaggaaaugaccaauagccgguuucccauuccgcuugagaagcuguucacagggccuucuuccgccuucguugugcagccccagaacggacgcuguaccacagauggcguccuccuggggaccacgcagcugagcccugugaauaucugcacauuuagaggagacgucacccauauuacaggcucucggaacuacaccaugaaucucgcuucccaaaacuggagcaauuaugaucccaccgaggaaaucccugcgccccugggcaucccggacuucguggggaaaauucagggaaugcuuacacagacgacccgcacagacggcuccaccagagggcacaaggccacaguuuacaccggaucugcugauuuugccccuaagcugggccgggugcaguucgagacggacacagaucaugacuuugaagccaaccaaaauaccaaauucacccccgucggggugauccaggauggaagcacaacccaccgcaacgagccccagcaauggguucucccuuccuacagcggcagaaauacaccgaacgugcaccuggcucccgccgucgcgccuacguuucccggcgaacagcuucuguucuuucggucuaccaugccuggguguuccggauaucccaauauggaccucgauugccugcugccucaggagugggugcaguacuucuaucaagaggcugcccccgcccagagcgacguggcucuccugagauuuguuaacccggauacaggccgcguccuuuucgaauguaagcugcauaaaucuggguacgugaccguggcccacacaggacagcaugaccucgucauuccucccaauggcuauuuucgguucgauagcugggugaaccaguucuacacccuggcuccuauggggaacggcacgggaagacgccgguga

SEQ ID NO: 29909 - RNA, 1617 nt, Artificial Sequence
  derived and/or modified sequence opt5 from VP1__Norovirus_and/or_Norovirus-like__KP176393
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccacacaccggaacgagccccaacaguggguccucccuuccuacagcggccgcaauacgccgaacgugcaccuggcucccgccguggcgccuaccuuucccggcgaacagcuucuguucuuuagaucuacaaugccuggguguuccggauaucccagcauggaccucgauugccugcugccucaggaguggguucaauacuucuaucaggaggcugcccccgcccagucugacgucgcucuccugcgguuugugaauccggauaccggcagagugcuuuucgaauguaagcugcauaaaagcggguacgucacaguggcccacaccggacagcaugaccucguuauuccucccaacggcuauuuucgcuucgauuccugggugaaucaauucuacacgcuggcuccuauggggaacggcaccggacggagacgcuga

SEQ ID NO: 29910 - RNA, 1617 nt, Artificial Sequence
  derived and/or modified sequence opt5 from VP1__Norovirus_and/or_Norovirus-like__KP096330
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggaccucgauugccugcugccucaggaguggguucaauacuucuaucaggaggcugcccccgcccaguccgacgucgcucuccugcgguuugugaacccggauaccgggagagugcuuuucgaauguaagcugcauaaaacaggauacgucaccguggcccacacgggccagcaugaccucguuauuccucccaauggguauuuucgcuucgauagcugggugaaccaauucuacacccuggcuccuaugggcaacggaacaggccggagacgcuga

SEQ ID NO: 29911 - RNA, 1617 nt, Artificial Sequence
  derived and/or modified sequence opt5 from VP1__Norovirus_and/or_Norovirus-like__KM982953
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagacaaaugaccccaccauuaagcucaucgccaugcuguauacaccccuucgcgcuaacaacgccggcgaugacguguucaccgucagcugcagagugcugacacggccuuccccggauuuugacuucauuuuucucguucccccuaccguggaaagccgcacgaaacccuucucugucccugugcugaccguugaggaaaugacaaauuccagauuucccaucccgcuugagaagcuguucaccgggccuagcucugccuucgugguccagccccagaacggacgguguacaaccgauggcgugcuccuggggacgacacaacuguccccugucaauauuugcaccuuucgcggagacgugacacauaucaccggcagcagaaacuacaccaugaaucucgcuucucagaacuggaauaacuaugaucccacagaggaaauuccugcgccccugggcaucccggacuucguugggaaaauccagggaaugcuuacgcagaccacacggaccgacggcuccacacgcgggcacaaggccaccguguacacgggaagcgucgauuuugcuccuaagcugggcagagugcaauucgagacagacaccgaucaugacuuugaagccaaucagaacaccaaauucacacccguuggggugauucaggauggauccaccacacaccggaaugagccccaacaguggguccucccuucuuacagcggccgcaacacgccgaaugugcaccuggcccccgcuguggccccuaccuuucccggcgaacagcuucuguucuuuagauccacaaugccuggguguagcggauaucccaacauggaccucgauugccugcugccucaggaguggguucaauacuucuaucaggaggcggcucccgcccagucugacgucgcccuccugcgguuugugaauccggauaccggcagagugcuuuucgaauguaagcugcauaaauccggguacgucacaguggcucacaccggacagcaugaccucguuaucccucccaacggcuauuuucgcuucgauagcugggugaaccaauucuacacgcuggccccuauggggaauggcaccggacggagacgcuga

SEQ ID NO: 29912 - RNA, 1617 nt, Artificial Sequence
  derived and/or modified sequence opt5 from VP1__Norovirus_and/or_Norovirus-like__KM982936
augaagauggccagcuccgacgcuaaccccucugauggcagcgccgcgaaucuggugccugaggucaacaaugaaguucucgcucuggagccgguggugggggccgccaucgcugcccccgucgcuggacagcaaaacgugauugacccuuggaucagaaauaacuucguucaggcccccggcggggaauuuaccguguccccucggaaugcgcccggagagauucuuuggucugccccucugggcccggaucucaaccccuaccugagccaccuugcucgcauguauaauggguacgccggaggcuucgaaguccaggugauccuggcuggcaacgccuuuacagcggggaaaguuauuuucgccgcugugccucccaauuuuccuacggagggacucucccccucucaggucaccauguucccgcauaucgugguggacgucagacaacuggagccuguucugaucccccucccugaugugcggaacaauuuuuaucacuacaaccagagcaaugaccccacaauuaagcugaucgccaugcuuuauacaccccugcgcgcuaacaacgccggcgaugacguguucaccgucuccugcagagugcucacccggccuagcccggauuuugacuucauuuuucugguucccccuacaguggaaucucgcaccaaacccuucuccgucccuauccuuacgguggaggaaaugaccaauagcagauuucccauuccgcuggagaagcuguucacagggccuucuuccgccuucguugugcagccccagaacggacgguguaccacagauggcguccugcuggggaccacgcaacucagcccugugaauaucugcacauuucgcggagacgucacccauauuacaggcucucacaacuacaccaugaaucuggcuucccagaacuggagcaauuaugaucccaccgaggaaaucccugcgccccuuggcacaccggacuucguggggaaaauccagggaguucugacgcagaccacaagaaccgacggcuccacacgggggcauaaggccaccguguacacgggaucugcugauuuugccccuaagcucggccgcguccaauucgagacagacaccgauagagacuuugaagccaaccagaauaccaaauucacacccguggggguuauucaggauggaggcaccacacaccggaacgagccccaacagugggugcugccuagcuacuccggccgcaauacgccgaacguccaccuugcucccgccguggcgccuaccuuucccggggaacagcuccucuucuuuagaagcacaaugccuggauguucuggcuaucccaauauggaccuggauugccugcucccucaggagugggugcaauacuucuaucaggaggcugcccccgcccaguccgacguugcucugcuucgguuugucaacccggauaccgggagagugcuguucgaauguaagcuccauaaaagcggauacgugacagucgcccacaccggccagcaugaccuggugaucccucccaauggguauuuucgcuucgauucuuggguuaaccaauucuacacgcuugcuccuaugggcaacggaaccggccggagacgcuga

SEQ ID NO: 29913 - RNA, 1617 nt, Artificial Sequence
  derived and/or modified sequence opt5 from VP1__Norovirus_and/or_Norovirus-like__KM514073
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugcuucuggcuggcaacgccuuuacagcggggaaaguuaucuucgccgcugugccucccaauuuuccuacggagggacucucccccucucaggucaccauguucccgcauauugugguggacgucagacaacuggagccuguucugaucccccucccugaugugcggaacaauuuuuaucacuacaaccagagcaaugaccccacaaucaagcugauugccaugcuuuauacaccccugcgcgcuaacaacgccggcgaugacguguucaccgucuccugcagagugcucacccggccuagcccggauuuugacuucaucuuucugguucccccuacaguggaaucucgcaccaaacccuucuccgucccugugcuuacgguugaggaaaugaccaauagcagauuucccauuccgcuggagaagcuguucacagggccuucuuccgccuucgugguccagccccagaacggacgguguaccacagauggcgugcugcuggggaccacgcaacucagcccugucaauaucugcacauuucgcggagacgugacccauauuacaggcucuagaaacuacaccaugaaucuggcuucccagaacuggagcaauuaugaucccaccgaggaaaucccugcgccccuuggcacaccggacuucguugggaaaauucagggaaugcugacgcagaccacacggaccgacggcuccacacgcgggcacaaggccaccguguacacgggaucugcugauuuugccccuaagcucggcagaguccaauucgagacagacaccgaucaugacuuugaagccaaccagaauaccaaauucacacccguggggguuauccaggauggaagcaccacacaccggaacgagccccaacagugggugcugccuuccuacagcggccgcaauacgccgaacguccaccuugcucccgccguggcgccuaccuuucccggcgaacagcuccucuucuuuagaucuacaaugccuggguguuccggauaucccaauauggaccuggauugccugcucccucaggagugggugcaauacuucuaucaggaggcugcccccgcccagagcgacguugcucugcuucgguuugucaacccggauaccggcagagugcuguucgaauguaagcuccauaaaucuggguacgugacagucgcccacaccggacagcaugaccuggugaucccucccaauggcuauuuucgcuucgauagcuggguuaaccaauucuacacgcuugcuccuauggggaacggcaccggacggagacgcuga

SEQ ID NO: 29914 - RNA, 1617 nt, Artificial Sequence
  derived and/or modified sequence opt5 from VP1__Norovirus_and/or_Norovirus-like__KM268086
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcuggcccggccuagcccggauuuugacuucauuuuucucguucccccuaccguggaaucucgcacaaaacccuucuccgucccugugcugaccguugaggaaaugacgaauagcagauuucccaucccgcuugagaagcuguucaccgggccuucuuccgcuuucgugguccagccccagaacggacgguguacaaccgauggcgugcuccuggggacaacccaacugagcccugucaauauuugcacguuucgcggagacgugacacauaucaccggcucuagaaacuacacaaugaaucucgcgucccagaacuggagcaauuaugaucccaccgaggaaauuccugcuccccugggcaccccggacuucguugggaaaauccagggagugcuuacacagacgacccggacagacggcuccacccgcgggcacaaggccacagucuacaccggaucugccgauuuugccccuaagcugggcagagugcaauucgagacggacacagaucaugacuuugaagcuaaccagaauaccaaauucacccccguuggggugauccaggauggaagcacaacccaccggaacgagccccaacaguggguccucccuuccuacagcggccgcaauacaccgaacgugcaccuggcccccgcgguggcuccuacguuucccggcgaacagcuucuguucuuuagaucuaccaugccuggguguuccggauaucccaauauggaccucgauugccugcugccucaggaguggguucaauacuucuaucaggaggccgcccccgcucagagcgacgucgcccuccugcgguuugugaacccggauacaggcagagugcuuuucgaauguaagcugcauaaaucuggguacgucaccguggcucacacaggacagcaugaccucguuauuccucccaauggcuauuuucgcuucgauagcugggugaaccaauucuacacccuggccccuauggggaacggcacgggacggagacgcuga

SEQ ID NO: 29915 - RNA, 1617 nt, Artificial Sequence
  derived and/or modified sequence opt5 from VP1__Norovirus_and/or_Norovirus-like__KM198552
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagcauuaacuggaauaacuaugacccuacagaagagauccccgccccucuggggacgcccgauuucgugggaaaaauucagggcguccuuacccagacaaccaagggggacggaucuacacggggccacaaggcuaccguguacacgggguccgccccguuuacaccuaaacugggaagcguucaguucuccaccgacaccgaaaaugauuuugagacacaucaaaacaccaaguucacacccgugggcgucauccaggacggcgggacgacccaccgcaaugaaccccagcaaugggugcucccuucuuacagcggaagagauguucacaacgugcaucuggccccggcugucgcccccacauuuccuggcgagcagcuucuguucuuucgguccaccaugcccggguguagcggauauccuaauauggaccucgauugccugcugccccaggagugggugcagcacuucuaccaagaagcggcuccugcccagucugacgccgcucuccugcgcuuugugaaccccgauacaggcagaguucuuuucgaguguaaacugcauaaguccggguaugucaccguggcccacacgggccagcacgaccucgugauuccgccuaauggauacuuucgguucgauagcugggucaaccaguucuauacccuggcucccaugggcaacgggacaggaagacgccgguga

SEQ ID NO: 29916 - RNA, 1617 nt, Artificial Sequence
  derived and/or modified sequence opt5 from VP1__Norovirus_and/or_Norovirus-like__KJ716358
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagcugugacccauaucacaggcucuagaaacuacaccaugaaucucgcgucccagaacuggagcaauuaugaccccaccgaggaaauuccugcuccccugggcacaccggauuucguugggaaaauccagggagugcuuacgcagaccacacggaccgacggcuccacacgcgggcacaaggccaccgucuacacgggaucugccgacuuugccccuaagcugggcagagugcaauucgagacagauaccgaccgggauuuugaagcuaaccagaauaccaaauucacacccguuggggugauccaggacggaagcaccacacaucgcaacgagccccaacaguggguccucccuuccuacagcggcagaaauacgccgaacgugcaccuggcccccgcgguggcuccuaccuuucccggcgaacagcuucuguucuuucggucuauuaugccuggguguuccggauaucccaauauggaucucgacugccugcugccucaggaguggguucaauacuucuaucaggaggccgcccccgcucagagcgaugucgcccuccugagauuugugaacccggacacaggccgcgugcuuuucgaauguaagcugcacaaaucuggguacgucaccguggcucauacaggacagcacgaucucguuaucccucccaauggcuauuuucgguucgacagcugggugaaccaauucuacacccuggccccuauggggaacggcacgggaagacgccgguga

SEQ ID NO: 29917 - RNA, 1617 nt, Artificial Sequence
  derived and/or modified sequence opt5 from VP1__Norovirus_and/or_Norovirus-like__KJ649702
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggaaugcuuacgcagaccacacggaccgacggcuccacacgcgggcacaaggccaccguguacacgggaucugcugauuuugccccuaagcugggcagaguccaauucgagacagacaccgaucgggacuuugaagccaaccagaauaccaaauucacacccguggggguuauccaggauggaagcaccacacaucgcaacgagccccaacagugggugcucccuuccuacagcggcagaaauacgccgaacguccaccuggcucccgccguggcgccuaccuuucccggcgaacagcuucuguucuuucggucuacaaugccuggguguuccggauaucccaauauggaccucgauugccugcugccucaggagugggugcaauacuucuaucaggaggcugcccccgcccagagcgacguugcucuccugagauuugucaacccggauaccggccgcgugcuuuucgaauguaagcugcacaaaucuggguacgugacagucgcccauaccggacagcacgaccucgugauuccucccaauggcuauuuucgguucgauagcuggguuaaccaauucuacacgcuggcuccuauggggaacggcaccggaagacgccgguga

SEQ ID NO: 29918 - RNA, 1617 nt, Artificial Sequence
  derived and/or modified sequence opt5 from VP1__Norovirus_and/or_Norovirus-like__KF429778
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucgccggcucuagaaacuacaccaugaaucucgcuucccagaacuggaauagcuaugaucccaccgaggaaaucccugcgccccugggcacaccggacuucgucgggaaaauucagggagugcuuacgcagaccacacggaccgacggcuccacacgcgggcacaaggccaccguuuacacgggaucugcugauuuuagcccuaagcugggcagagugcaauucgccacagacaccgauaacgacuuugucaccaaucagaacacaaaauucacccccguggggguuauccaggauggaggcacaacgccccggaaugagccucaacagugggugcucccguccuacagcggccgcaacacccauaauguccaccuggcccccgcuguggccccuacauuucccggggaacagcuucuguucuuuagaucuaccaugccuggauguuccggcuaucccaacauggaccucgauugccugcugccucaggagugggugcaauacuucuaucaggaagcggcucccgcccagagcgacguugcccuccugcgguuugucaauccggauacagggagagugcuuuucgaguguaagcugcacaaaucuggauacgugaccgucgcucauacgggccagcacgaccucgugauuccucccaacggguauuuucgcuucgauagcuggguuaaccaauucuacacccuggccccuaugggcaauggaacaggccggagacgcuga

SEQ ID NO: 29919 - RNA, 1617 nt, Artificial Sequence
  derived and/or modified sequence opt5 from VP1__Norovirus_and/or_Norovirus-like__KF060113
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcgccaaacccuucuccgucccugugcugaccguugaggaaaugacgaauagcagauuucccaucccgcuugagaagcuguucaccgggccuucuuccgcuuucgugguccagccccagaacggacgguguacaaccgauggcgugcuccuggggacaacccaacugagcccugucaauauuugcacguuucgcggagacgugacacauaucaccggcucuagaaacuacacaaugaaucucgcgucccagaacuggagcaauuaugaucccaccgaggaaauuccugcuccccugggcaccccggacuucguugggaaaauccagggagugcuuacacagacgacccggacagacggcuccacccgcgggcacaaggccacagucuacaccggaucugccgauuuugccccuaagcugggcagagugcaauucgagacggacacagaucaugacuuugaagcuaaccagaauaccaaauucacccccguuggggugauccaggauggaagcacaacccaccggaacgagccccaacaguggguccucccuuccuacagcggccgcaauacaccgaacgugcaccuggcccccgcgguggcuccuacguuucccggcgaacagcuucuguucuuuagaucuaccaugccuggguguuccggauaucccaauauggaccucgauugccugcugccucaggaguggguucaauacuucuaucaggaggccgcccccgcucagagcgacgucgcccuccugcgguuugugaacccggauacaggcagagugcuuuucgaauguaagcugcauaaaucuggguacgucaccguggcucacacaggacagcaugaccucguuauuccucccaauggcuauuuucgcuucgauagcugggugaaccaauucuacacccuggccccuauggggaacggcacgggacggagacgcuga

SEQ ID NO: 29920 - RNA, 1617 nt, Artificial Sequence
  derived and/or modified sequence opt5 from VP1__Norovirus_and/or_Norovirus-like__KF060106
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugguucuugccggcaacgcuuuuacggccgggaaaaucauuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuguccugaccguggaggaaaugacaaauagcagauuucccauuccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauuucuggcuccagaaacuacaccaugaaucucgccagccagaacuggaacuccuaugaucccaccgaggaaaucccugcuccccugggcacaccggacuucguggggaaaauccagggaguucuuacgcagaccacacggaccgacggcucuacacgcgggcacaaggcgaccguguacacgggaagcgccgauuuuuccccuaagcugggcagaguccaauucgcuacagacaccgauaaugacuuugugaccaaucagaacacaaaauucacccccguuggggugauucaggauggaagcacaacgccccggaaugagccucaacaguggguccucccgucuuacuccggccgcaacacccauaaugugcaccuggcccccgccguggcuccuacauuucccggcgaacagcuucuguucuuuagaagcaccaugccuggguguucuggauaucccaacauggaccucgauugccugcugccucaggaguggguucaauacuucuaucaggaagccgcgcccgcucagagcgacgucgcccuccugcgguuugugaauccggauacaggcagagugcuuuucgaguguaagcugcacaaauccggguacgucaccguggcccauacgggacagcacgaccucguuaucccucccaacggcuauuuucgcuucgauucuugggugaaccaauucuacacccuggcuccuauggggaauggcacaggacggagacgcuga

SEQ ID NO: 29921 - RNA, 1617 nt, Artificial Sequence
  derived and/or modified sequence opt5 from VP1__Norovirus_and/or_Norovirus-like__KF060100
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcucccacaacuacaccaugaaucucgccagccagaacuggaacuccuaugaucccaccgaggaaaucccugcuccccugggcacaccggacuucgucgggaaaauucagggaaugcuuacgcagaccacaagaaccgacggcucuacacgggggcauaaggcgaccguguacacgggaagcguugauuuuuccccuaagcugggccgcgugcaauucacaaccgacaccgauaaugacuuugagacaaaucagaacaccaaauucacacccgucggggugauccaggauggaagcacgacccacagaaaugaaccccaacaguggguucucccuucuuacuccggccggaacacacacaaugugcaucuggccccggcugucgcccccaccuuuccuggcgagcagcuucuguucuuucgcagcacaaugcccggguguucuggauauccuaacauggaccucgauugccugcugccccaggaaugggugcaauacuucuaucaggaggccgcuccugcccagagcgacguggcgcuccugagauuuguuaaucccgauaccggccggguccuuuucgaguguaagcugcacaaauccggguacgugacgguggcucauaccggacagcacgaccucgucauuccgccuaacggcuauuuuagauucgauucuugggugaaccaauucuacacacuggcccccauggggaauggcaccggacgccggagauga

SEQ ID NO: 29922 - RNA, 1617 nt, Artificial Sequence
  derived and/or modified sequence opt5 from VP1__Norovirus_and/or_Norovirus-like__KF060069
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcucccacaacuacaccaugaaucucgccagccagaacuggaacuccuaugaucccaccgaggaaaucccugcuccccugggcacaccggacuucgucgggaaaauucagggagugcuuacgcagaccacaagaaccgacggcucuacacgggggcauaaggcgaccguuuacacgggaagcgccgauuuuuccccuaagcugggccgcgugcaauucgcuacagacaccgauaaugacuuugucaccaaucagaacacaaaauucacccccguggggguuauccaggauggaagcacaacgcccagaaaugagccucaacagugggugcucccgucuuacuccggccggaacacccacaauguccaccuggcccccgccguggcuccuacauuucccggcgaacagcuucuguucuuucgcagcaccaugccuggguguucuggauaucccaacauggaccucgauugccugcugccucaggagugggugcaauacuucuaucaggaagccgcgcccgcucagagcgacguugcccuccugagauuugucaauccggauacaggccgggugcuuuucgaguguaagcugcauaaauccggguacgugaccgucgcccacacgggacagcaugaccucgugauuccucccaacggcuauuuuagauucgauucuuggguuaaccaauucuacacccuggcuccuauggggaauggcacaggacgccggagauga

SEQ ID NO: 29923 - RNA, 1617 nt, Artificial Sequence
  derived and/or modified sequence opt5 from VP1__Norovirus_and/or_Norovirus-like__KF060055
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcuaugaccccaccauuaagcucaucgcuaugcuguacacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacauauccccggcucucacaauuauaccaugaaccucgccucccagaauuggaacagcuacgauccuaccgaggaaauccccgcuccgcugggcacaccugacuucgucgggaaaauucagggagugcuuacgcagaccacaaagaccaauggcuccacaagagggcauaaggcgaccguuuacacgggaucugccgacuuuagccccaaacugggccgggugcaauucgcuacagauaccaacaaugacuuugagaccaaccagaauacaaaguucacccccgucggggugauccaggauggauccacaacgccucgcaacgaaccgcaacaguggguucuccccagcuauucuggcagaaauauucacaacgugcaccuggccccugccgucgcucccaccuuuccuggcgagcagcuucuguucuuucgguccacaaugcccggguguagcggauacccuaauauggaccucgauugccugcugccccaggaaugggugcaauauuucuaccaggaggccgcgccggcucagucugacguggcccuccugcgcuuuguuaacccugauaccggcagaguccuuuucgaguguaaacugcauaagagcggguaugugacaguggccuacaccggacagcacgaccucgucauucccccuaacggcuauuuucgguucgauuccugggugaaucaauucuacacgcuggcucccauggggaacggcaccggaagacgccgguga

SEQ ID NO: 29924 - RNA, 1617 nt, Artificial Sequence
  derived and/or modified sequence opt5 from VP1__Norovirus_and/or_Norovirus-like__KF060028
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucauugucgacgugagacaacucgagccugugcugaucccccugccugauguccggaauaacuuuuaucauuacaaucagagcaacgaccccaccauuaagcucaucgcuaugcuguauacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacacaucucuggcuccagaaauuacaccaugaaccucgccagccagaauuggaacuccuaugaucccaccgaggaaaucccugcuccccugggcacaccggacuucgucgggaaaauucagggagugcuuacgcagaccacacgggcggacggcucuacccgcgggcauaaggccacaguuuacaccggaagcgcugauuuuuccccuaagcugggcagagugcaauucgccacggacacagauaaugacuuugucgccaaccagaauaccaaauucacccccguggggguuauccaggauggaagcacaacaccccggaacgagccucaacagugggugcucccgucuuacuccggccgcaauacccacaacguccaccuggcucccgccguggcgccuacguuucccggcgaacagcuucuguucuuuagaagcaccaugccuggguguucuggauaucccaauauggaccucgauugccugcugccucaggagugggugcaauacuucuaucaggaagcugcccccgcccagagcgacguugcucuccugcgguuugucaacccggauacaggcagagugcuuuucgaguguaagcugcauaaauccggguacgugaccgucgcccacacaggacagcaugaccucgugauuccucccaauggcuauuuucgcuucgauucuuggguuaaccaauucuacacccuggcuccuauggggaacggcacgggacggagacgcuga

SEQ ID NO: 29925 - RNA, 1617 nt, Artificial Sequence
  derived and/or modified sequence opt5 from VP1__Norovirus_and/or_Norovirus-like__KF060022
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcgccuuucgcggagacgugacccauaucucuggcuccagaaacuacacaaugaaucucgcuagccagaacuggaacuccuaugaucccaccgaggaaaucccugcgccccugggcaccccggacuucgucgggaaaauucagggaaugcuuacacagacgacccggacagacggcucuacccgcgggcacaaggccacaguguacaccggaagcgcugauuuuuccccuaagcugggcagaguucaauucgccacggacacagauaaugacuuugugaccaaucagaacaccaaauucacacccgucggggugauccaggauggaagcaccacaccccggaaugagccucaacaguggguucucccgucuuacuccggccgcaacacgcauaaugugcaccuggcccccgcugucgccccuaccuuucccggcgaacagcuucuguucuuuagaagcacaaugccuggguguucuggauaucccaacauggaccucgauugccugcugccucaggagugggugcaauacuucuaucaggaagcggcucccgcccagagcgacguggcccuccugcgguuuguuaauccggauaccggcagaguccuuuucgaguguaagcugcacaaauccggguacgugacaguggcucauaccggacagcacgaccucgucauuccucccaacggcuauuuucgcuucgauucuugggugaaccaauucuacacgcuggccccuauggggaauggcaccggacggagacgcuga

SEQ ID NO: 29926 - RNA, 1617 nt, Artificial Sequence
  derived and/or modified sequence opt5 from VP1__Norovirus_and/or_Norovirus-like__KC517376
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcugucuacagggccuuccagcgccuucgugguccagccccagaacggacgguguaccacagauggcgugcuccuggggaccacgcaacugucuccugucaauauuugcacauuccgcggagacgugacccauaucacaggcuccagaaacuacaccaugaaucucgcuagccagaacuggaauaacuaugaucccaccgaggaaauuccugcgccccugggcacaccggacuuuguugggaaaauccagggagugcuuacgcagaccacacggaccgacggcuccacacgcgggcacaaggccaccgucuacacgggaucugcugauuucgccccuaagcugggcagagugcaauuugagacagacaccgaucaugacuucgaagccaaucagaacaccaaauuuacacccguuggggugauccaggauggaggcaccacacaccggaaugagccccaacaguggguccucccuagcuacuccggccgcaacacgcacaaugugcaucuggcuccggccguggcgcccaccuucccuggggaacagcuucuguuuuucagaagcacaaugcccggauguucuggcuauccuaacauggaccucgauugccugcugccccaggaguggguucaauacuuuuaucaggaggcugccccugcccaguccgacgucgcucuccugcgguucgugaaucccgauaccgggagagugcuuuuugaauguaagcugcacaaaagcggauacgucacaguggcccauaccggccagcacgaccucguuauuccgccuaacggguauuuccgcuuugauucuugggugaaccaauucuacacgcuggcucccaugggcaauggaaccggccggagacgcuga

SEQ ID NO: 29927 - RNA, 1617 nt, Artificial Sequence
  derived and/or modified sequence opt5 from VP1__Norovirus_and/or_Norovirus-like__KC517374
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucacagucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaaccccugcgccccugggcacgccggacuucguugggaaaauucagggagugcuuacccagacaacccggacagacggcagcacccgcgggcacaaggccacggucuacacaggauccgcugauuuugccccuaagcugggcagagugcaauucgagaccgacaccgaucaugacuuugaagccaaucagaacacaaaauucacccccguuggggugauccaggauggaggcacaacgcaccggaaugagccccaacaguggguccucccuucuuacagcggccgcaacacccacaaugugcaucuggcuccggccguggcgcccacauuuccuggggaacagcuucuguucuuuagauccaccaugcccggauguagcggcuauccuaacauggaccucgauugccugcugccccaggaguggguucaauacuucuaucaggaggcugccccugcccacucugacgucgcucuccugcgguuugugaaucccgauacagggagagugcuuuucgaauguaagcugcauaaauccggauacgucaccguggcccacacgggccagcacgaccucguuaucccgccuaacggguauuuucgcuucgauagcugggugaaccaguucuacacccuggcucccaugggcucuggaacaggccggagacgcuga

SEQ ID NO: 29928 - RNA, 1617 nt, Artificial Sequence
  derived and/or modified sequence opt5 from VP1__Norovirus_and/or_Norovirus-like__KC409308
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaauggaugcugccuucuuacagcggaagagaugugcacaacguucaucuugccccggcuguggcccccacauuuccuggcgagcagcuccuguucuuucgguccaccaugcccggguguagcggauauccuaauauggaccuggauugccugcucccccaggaguggguccagcacuucuaccaagaagcggcuccugcccagucugacguggcccugcuucgcuuugugaaccccgauacaggcagaguucuguucgaguguaaacuccauaaguccggguaugucaccguggcucacacgggccagcacgaccuggugaucccgccuaauggauacuuucgguucgauagcugggucaaccaguucuauacccuugcccccaugggcaacgggacaggaagacgccgguga

SEQ ID NO: 29929 - RNA, 1617 nt, Artificial Sequence
  derived and/or modified sequence opt5 from VP1__Norovirus_and/or_Norovirus-like__KC175393
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucagagugauccuugcuggcaacgccuuuacagcggggaaaauuaucuucgccgcuguuccucccaauuuuccuacggagggacugucccccucucaggugaccauguucccgcauaucauugucgacgugcggcagcucgagccugugcugaucccccugccugauguccgcaacaauuuuuaucacuacaaccaaacaaaugacagcaccauuaagcucaucgccaugcuguauacaccccuuagagcuaacaacgccggcgaagauguuuucaccguguccugccgggugcugacacgccccagcccugacuuugauuucauuuuucucgucccgcccaccguggagucuagaacgaaaccuuucaccguucccauccugacaguggaagagaugaccaauucccgguuuccuauuccccuugagaagcuguucacagggccgagcggagccuucgucgugcagccucagaacggccgcuguaccacggacgggguucuccugggaacaacccagcugucucccguguccaucugcacauuuagaggcgaugucacccauaucgcuggcagccggaauuacaccaugaaccucgcgucucugaauuggaacaauuaugacccuacagaagagauucccgccccucuugggacgcccgauuucgugggaaaaauccaaggcguccugacccagacaaccaagggggacggauccacacgcggccacaaggcuaccguguacacggggagcgccccguuuacaccuaaacucggauccguucaguucucuaccgacaccgaaaacgauuuugagacacaucagaauaccaaguucacacccgugggcgucauucaagacggcgggacgacccacagaaacgaaccccagcagugggugcugccuagcuacuccggacgggauguucacaaugugcaucuugccccggcugucgcccccacauuuccuggcgagcaacuccuguucuuucgcagcaccaugcccggguguucuggauauccuaacauggaccuggauugccugcucccccaggagugggugcagcacuucuaccaggaagcggcuccugcccaauccgacguggcccugcuuagauuuguuaaucccgauacaggccggguccuguucgaguguaaacuccauaagagcggguaugugaccguggcucacacgggccagcacgaccuggucaucccgccuaacggauacuuuagauucgauucuugggugaaucaguucuauacccuugcccccaugggcaacgggacaggacgccggagauga

SEQ ID NO: 29930 - RNA, 1617 nt, Artificial Sequence
  derived and/or modified sequence opt5 from VP1__Norovirus_and/or_Norovirus-like__JX459623
augaagauggccagcaacgaccccaauccuuccgauggcucugcugccaaccuggugccggaggucaauaacgaaguuauggcgcucgagcccguggugggggcugccaucgccgcuccugucgccggacagcaaaaugugauugaccccuggaucagaaacaauuucguucaggcuccuggcggggaauuuaccgugagcccccggaacgccccuggagagauucugugguccgcgccgcuuggccccgaucugaauccuuaccucucucaccuggcccgcauguauaacggguacgcuggaggcuucgaaguccaggugauccuugccggcaaugcuuuuacagccgggaaaauuaucuucgcggccguucccccuaacuuucccacggagggacugagcccgucccaggugaccauguucccucauaucauugucgacgugagacaacucgagcccgugcugaucccucugcccgauguccggaauaacuuuuaucacuacaaucagucuaacgacagcacaauuaagcucaucgcuaugcuguauacaccccuucgcgccaacaaugcuggcgaagauguuuucaccguguccugcagagugcugacccggccuagcccggacuuugauuucauuuuucucgugcccccuacagucgagucucgcaccaaacccuucacgguuccuauccugaccguggaagagaugacaaacuccagauuucccauuccgcuugagaagcuguucaccgggccuagcggagccuucgucgugcagccccagaauggccgguguacaaccgacgggguucuccugggaacgacacaacugucuccugugaacaucugcaccuuucgcggcgaugucacacauaucgccggcaccagaaauuacaccaugaaccucgcuucccugaauuggaacaauuaugaccccacagaagagauuccugcgccccuugggacgccggauuucgugggaaaaauccagggcguccugacccagacaaccaagggggacggaagcacacggggccacaaggccaccguguacacggggucugcuccuuuuacacccaaacucggauccguucaguucagcaccgacaccgaaaacgauuuugagacacaucaaaauaccaaguucacacccgugggcgucauucaggacggcgggacgacccaccgcaacgaaccucagcaaugggugcugccguccuacucuggaagaaauguucacaacgugcaucuugcccccgccgucgcuccuacauuucccggcgagcagcuccuguucuuucggagcaccaugccuggguguuccggauaucccaauauggaucuggacugccugcucccucaggagugggugcagcacuucuaccaagaagccgcgcccgcucagagcgauguggcccugaugcgcuuuguuaacccggacacaggcagaguccuuuucgaguguaaacugcauaagucuggguaugugaccguggcccacacgggccagcacgaucucgucaucccucccaacggauacuuucgguucgacuccugggugaaucaguucuauacccuggcuccuaugggcaacgggacaggaagacgccgguga

SEQ ID NO: 29931 - RNA, 1617 nt, Artificial Sequence
  derived and/or modified sequence opt5 from VP1__Norovirus_and/or_Norovirus-like__JQ798158
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucgcccaccuggcucgcauguauaacggguacgccggaggcuucgaaguccaggugauccuugcuggcaaugccuuuacggcggggaaaauuaucuucgccgcuguuccucccaacuuuccuaccgagggacugucucccagccaggugacaauguucccgcauaucgucguggacgugagacaacucgagccuguccugauuccccugccugauguuggcaauaacuuuuaucacuacaaucaguccaacgaccccaccaucaagcucauugccaugcuguauacaccccuucgggcuaacaaugccggggaagauguguucaccgugucuugccgcguccugacaagaccuagcccggacuuugauuucaucuuucucgugcccccuaccguugagucccggacgaaacccuucaccgugccuauucugacagucgaagagaugaccaacagccgcuuucccaucccgcuugagaagcuguucacaggaccuucuggcgccuucgugguucagccccagaaugggagauguaccacggacggagugcuccugggcacaacccaacuguccccugucaacauuugcacauuucggggcgaugugacccauaucgcugggacccacaauuacacaaugaaccucgcgagccagaauuggaacaauuaugaccccacggaagagaucccugcuccccugggaaccccggauuucgucggccgcauucaggggaugcuuacacagaccacaagaggagacggcucuacccgggggcauaaagccacgguguccacaggagacguucacuuuaccccuaagcugggcagcauccaauucaacaccgauacaaauaacgacuuugaaaccggccagaauacaaaguucacgcccgugggggucgugcaggauggaaacggcgcccaccaaaaugagccccagcaguggguucucccuucuuacuccgggcgcaccggacauaacgugcaccuggccccggcugucgcccccacauuuccuggcgaacagcuucuguucuuuagaagcaccaugcccggguguuccggcuacccuaacaugaaucucgacugccugcugccccaagagugggugcagcauuucuaucaggaggcggcuccugcccagucugauguggcccuccugcgguuuguuaaccccgacacaggacgcguccuuuucgaauguaaacugcacaagagcggcuacgugaccguggcucacacggggcaacaugaucucgucauuccgccuaauggauauuuuagauucgacuccugggugaaccaguucuacacccuggcccccaugggcaaugggacaggacggagacgcuga

SEQ ID NO: 29932 - RNA, 1617 nt, Artificial Sequence
  derived and/or modified sequence opt5 from VP1__Norovirus_and/or_Norovirus-like__JQ613566
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccgugccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauucccggcucuagaaacuacaccaugaaucucgccucccagaacuggaauagcuaugauccuaccgaggaaauccccgcuccgcugggcacaccugacuucguggggaaaauccagggaguucuuacgcagaccacacggaccaacggcuccacacgcgggcacaaggcgaccguguacacgggaucugccgacuuuagccccaagcugggcagaguccaauucgcuacagauaccgacaaugauuuugagaccaaccagaauacaaaauucacccccguggggguuauucaggacggauccacaacgccucggaacgaaccgcaacagugggugcuccccagcuacucuggccgcaauauccauaacguccaccuggccccugccguggcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguugcccuccugcgguuugucaacccugacaccggcagagugcuuuucgaguguaagcugcacaaaagcggguacgugacagucgcccauaccggacagcacgaucucgugauucccccuaacggcuauuuucgcuucgacuccuggguuaaucaauucuacacgcuggcucccauggggaacggcaccggacggagacgcuga

SEQ ID NO: 29933 - RNA, 1617 nt, Artificial Sequence
  derived and/or modified sequence opt5 from VP1__Norovirus_and/or_Norovirus-like__AB541287
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugguucuugcuggcaaugccuuuacagcggggaaagugaucuucgccgcugucccucccaacuuuccuacggagggacugagccccucccaggugaccauguucccgcauauuaucguggacgucagacaacucgagccuguucugaucccccugccugaugugcggaauaacuuuuaucacuacaaucagucuaacgacagcacaauuaagcucaucgccaugcuguauacaccccuucgcgcuaacaaugccggcgaagauguguucaccgucuccugcagagugcugacccggcccagcccugacuuugauuucauuuuucucguuccgcccacaguggagucucgcaccaaaccuuucacgguccccauccugaccguggaagagaugacaaacuccagauuuccuauuccccuugagaagcuguucaccgggccgagcggagccuucguugugcagccucagaauggccgguguacaaccgacgggguccuccugggaacgacacaacugucucccgugaacaucugcaccuuucgcggcgaugucacacauauugcuggcuccagaaauuacaccaugaaccucgcgagccugaauuggaacaauuaugacccuaccgaagagauccccgccccucuugggacacccgauuucgugggaaaaauccagggcguucugacgcagaccacaaagggggacggaucuacccggggccacaaggcuacaguguacaccggguccacgccguuuacaccuaaacucggaagcguccaguucuccaccgacaccgaaaacgauuuugagaaucaucaaaacacaaaguucacccccgugggcguuauucaggacggcgggacaacgcaccgcaaugaaccccagcaaugggugcugccuucuuacagcggaagaaacguccagaaugugcaccuugccccggccguggcucccaccuuuccuggcgagcagcuccuguucuuucgguccacaaugcccggguguagcggauauccuaacauggaucuggacugccugcucccccaggaguggguucaacauuucuaccaggaagccgcgccugcucagucugaugucgcccugcuucgcuuugugaaccccgacaccggcagagugcuguucgaguguaaacuccacaaguccggguaugucacaguggcccauaccggccagcacgaucugguuaucccgccuaauggauacuuucgguucgacagcugggugaaccaauucuauacgcuugcucccaugggcaaugggaccggaagacgccgguga

SEQ ID NO: 29934 - RNA, 1617 nt, Artificial Sequence
  derived and/or modified sequence opt5 from VP1__Norovirus_and/or_Norovirus-like__AB504320
augaagauggccagcaacgacgcuaaucccuccgauggcucugccgcgaaccuggugccugaggucaauaacgaaguuauggcucucgagccgguggccggggccgcuaucgccgcucccguggccggacagcaaaaugucauugacccuuggaucagaaacaauuucgugcaggcgcccggcggggaauuuaccguuagcccucggaacgcccccggagagauucugugguccgcuccucuuggcccggaucugaaucccuaccucucucaccuggcccgcauguauaacggguacgcuggaggcuucgaagugcaggucauccuugccggcaaugcguuuacagccgggaaaauuaucuucgcugccgugccucccaacuuuccuacggagggacugagccccucccagguuaccauguucccgcauaucauuguggacgucagacaacucgagccugugcugaucccccugccugaugugcggaauaacuuuuaucacuacaaucagucuaacgacagcacaauuaagcucaucgcuaugcuguauacaccccuucgcgccaacaaugccggcgaagaugucuucaccguuuccugcagagugcugacccggcccagcccugacuuugauuucauuuuucucgugccgcccacagucgagucucgcaccaaaccuuucacggugcccauccugaccguugaagagaugacaaacuccagauuuccuauuccccuugagaagcuguucaccgggccgagcggagcuuucgugguccagccucagaauggccgguguacaaccgacggggugcuccugggaacgacacaacugucucccguuaacaucugcaccuuucgcggcgaugugacacauaucgcgggcaccagaaauuacaccaugaaccucgccucccugaauuggaacaauuaugacccuacagaagagauucccgcuccucuugggacgcccgauuucgucggaaaaauccagggcgugcugacccagacaaccaagggggacggaagcacacggggccacaaggccaccgucuacacggggucugccccguuuacaccuaaacucggauccgugcaguucagcaccgacaccgaaaacgauuuugagacacaucaaaauaccaaguucacacccguuggcgugauucaggacggcgggacgacccaccgcaacgaaccccagcaauggguccugccuuccuacucuggaagaaaugugcacaacguucaucuugcuccggccguggcgcccacauuuccuggcgagcagcuccuguucuuucggagcaccaugcccggguguuccggauauccuaauauggaucuggacugccugcucccccaggaguggguccagcacuucuaccaagaagcugccccugcccagagcgauguggcucugaugcgcuuugugaaccccgacacaggcagaguucuuuucgaguguaaacugcauaagucuggguaugucaccguggcccacacgggccagcacgaucucgugaucccgccuaacggauacuuucgguucgacuccugggucaaucaguucuauacccuggcucccaugggcaacgggacaggaagacgccgguga

SEQ ID NO: 29935 - RNA, 1617 nt, Artificial Sequence
  derived and/or modified sequence opt5 from VP1__Norovirus_and/or_Norovirus-like__KU683739
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggaaugcuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauccaggauggaagcaccacacaccggaacgagccccaacagugggugcucccuuccuacagcggccgcaauacgccgaacguccaccuggcucccgccguggcgccuaccuuucccggcgaacagcuucuguucuuuagaucuacaaugccuggguguuccggauaucccaauauggaccucgauugccugcugccucaggagugggugcaauacuucuaucaggaggcugcccccgcccagagcgacguugcucuccugcgguuugucaacccggauaccggcagagugcuuuucgaauguaagcugcauaaaucuggguacgugacagucgcccacaccggacagcaugaccucgugauuccucccaauggcuauuuucgcuucgauagcuggguuaaccaauucuacacgcuggcuccuauggggaacggcaccggacggagacgcuga

SEQ ID NO: 29936 - RNA, 1617 nt, Artificial Sequence
  derived and/or modified sequence opt5 from VP1__Norovirus_and/or_Norovirus-like__KX354146
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccugugcugacggucgaggaaaugaccaauagcagacuucccaucccgcuggagaagcucuuuacagggccuucuuccgccuucgugguucagccccagaacggacgguguaccacagauggcgugcugcuggggaccacgcaacucagcccugucaauauuugcacauuccgcggagacgugacccauaucacaggcucuagaaacuacaccaugaaucuggcuucccagaacuggaauaacuaugaucccaccgaggaaaucccugcgccccuuggcacaccggacuuugucgggaaaauucagggaaugcugacgcagaccacacggaccgacggcagcacacgcgggcacaaggccaccguguacacgggauccgcugauuucgccccuaagcucggcagaguucaauuugagacagacaccgaucaugacuucgaagccaaucagaacaccaaauuuacacccgugggggucauccaggauggaucuaccacacaccggaaugagccccaacagugggugcugccuagcuacuccggccgcaacacgcacaauguucaucuugcuccggccguggcgcccaccuucccuggcgaacagcugcucuuuuucagaagcacaaugcccggguguucuggauauccuaacauggaccuggauugccugcucccccaggaguggguccaauacuuuuaucaggaggcugccccugcccaguccgacguggcucugcuucgguucgugaaucccgauaccggcagaguucuguuugaauguaagcuccacaaaagcggguacgucacaguggcccauaccggacagcacgaccuggugauuccgccuaacggcuauuuccgcuuugauucuugggucaaccaauucuacacgcuugcucccauggggaauggcaccggacggagacgcuga

SEQ ID NO: 29937 - RNA, 1617 nt, Artificial Sequence
  derived and/or modified sequence opt5 from VP1__Norovirus_and/or_Norovirus-like__KX354075
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucaccaaucagaacacaaaauucacccccguggggguuauccaggauggaagcacaacgccccggaaugagccucaacagugggugcucccgucuuacuccggccgcaacgcccauaauguccaccuggcccccgcuguggccccuaccuuucccggcgaacagcuucuguucuuuagaagcacaaugccuggguguucuggauaucccaacauggaccucgauugccugcugccucaggagugggugcaauacuucuaucaggaagcggcucccgcccagagcgacguugcccuccugcgguuugucaauccggauaccggcagagugcuuuucgaguguaagcugcacaaauccggguacgugacagucgcucauaccggacagcacgaccucgugauuccucccaacggcuauuuucgcuucgauucuuggguuaaccaauucuacacgcuggccccuauggggaauggcaccggacggagacgcuga

SEQ ID NO: 29938 - RNA, 1617 nt, Artificial Sequence
  derived and/or modified sequence opt5 from VP1__Norovirus_and/or_Norovirus-like__KX354072
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaaaggguacgccggaggcuucgaaguccaggugauccuugcuggcaacgccuuuacagcggggaagauuaucuucgccgcuguuccucccaauuuuccuacggagggacugagccccucccaggugaccauguucccgcauaucauugucgacgugagacaacucgagccugugcugaucccccugccugauguccggaacaauuuuuaucacuacaaccagucuaaugacagcacaauuaaacucaucgccaugcuguauaccccuccccgcgcuaacaacgccggcgaugacguuuucacaguguccugcagagugcuuacccggcccagcccggauuuugacuucauuuuucuggugcccccuacagucgaaucucgcaccaagcccuucacgguuccuauccucaccguggaggaaaugacaaauuccagauuucccauuccgcuggagaaacuuuucaccgggccuagcucugccuucgucgugcagccccagaacggacgguguacaaccgauggcguucugcucgggacgacacaacuguccccugugaauaucugcaccuuucgcggagacgucacacauaucgcuggcagcagaaacuacaccaugaaucuggcgucucucaacuggaauaacuaugaucccaccgaggaaauuccugcuccccugggcacaccggacuucguggggaagauccagggaguccuuacgcagaccacaaagggcgacggguccacccggggacacaaagccacaguguacaccggcagcgccgauuuuacgccuaagcugggguccguucaguucgccacagacaccgagaaugauuuugaaacccaucaaaacacacgcuucacccccgugggagucauucaggacggcucuacaacgcacagaaaugagccccagcaaugggugcucccuagcuacuccggccggaacguucacaaugugcaucuggcuccggccgucgcgcccaacuuuccuggggaacagcuucuguucuuucgcagcaccaugcccggauguucuggcuauccuaauauggaucucgacugccugcugccccaggagugggugcagcacuucuaccaagaggcugccccugcccaguccgauguggcucuccugagauuuguuaaccccgacacagggcggguccuuuucgaauguaaacugcauaagagcggauaugugaccguggcccacacaggccagcacgaucucgucaucccgccuaacggguacuuuagauucgacucuugggugaaucaguucuauacccuggcucccaugggcaacggaacgggccgccggagauga

SEQ ID NO: 29939 - RNA, 1617 nt, Artificial Sequence
  derived and/or modified sequence opt5 from VP1__Norovirus_and/or_Norovirus-like__KX354060
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaauuccugcuccccugggcacaccggacuucguggggaaaauccagggaguccuuacgcagaccacaucuaccaauggcagcacaagagggcauaaggcgaccguguacacgggauccgccgacuuuagcccuaagcugggccggguucaauucgcuacagauaccaauaacgacuuugagaccaaucagaacacaaaauucacccccgugggggucauucaggauggaucuacaacgccccgcaaugaaccucaacagugggugcucccguccuacagcggcagaaacauccacaauguucaccuggcccccgccguggcuccuaccuuucccggcgagcagcuucuguucuuucggucuacaaugccuggguguagcggauaucccaacauggaccucgauugccugcugccucaggaauggguccaacauuucuaccaggaggccgcgcccgcucaguccgacguggcccuccugcgcuuugugaacccggauaccggcagaguucuuuucgaguguaagcugcacaaaucuggguaugucacaguggcccauaccggacagcacgaccucgugauuccucccaauggcuacuuucgguucgauagcugggucaaccaauucuauacgcuggcuccuauggggaauggcaccggaagacgccgguga

SEQ ID NO: 29940 - RNA, 1617 nt, Artificial Sequence
  derived and/or modified sequence opt5 from VP1__Norovirus_and/or_Norovirus-like__KX353959
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccgccacaccucggaacgaaccgcaacaguggguucuccccagcuacucuggccgcaauauucauaacgugcaccuggccccugcugucgcccccacguuuccuggcgagcagcuucuguucuuuagauccaccaugcccggguguagcggauauccuaauauggaucucgacugccugcugccccaggaaugggugcaauacuucuaucaggaggcggcuccggcccagucugauguggcccuccugcgguuuguuaacccugacacaggcagaguccuuuucgaguguaagcugcacaaaagcggguacgugaccguggcucauacaggacagcacgaucucgucauucccccuaacggcuauuuucgcuucgacuccugggugaaucaauucuacacccuggcccccauggggaacggcacgggacggagacgcuga

SEQ ID NO: 29941 - RNA, 1617 nt, Artificial Sequence
  derived and/or modified sequence opt5 from VP1__Norovirus_and/or_Norovirus-like__KX353954
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcuccauucauaaugugcaccuggccccugccgucgcucccaccuuuccuggcgagcagcuucuguucuuuagaagcacaaugcccggguguucuggauauccuaacauggaucucgacugccugcugccccaggaaugggugcaauacuucuaucaggaggccgcgccggcucagagcgauguggcccuccugcgguuuguuaauccugacaccggcagaguccuuuucgaguguaagcugcacaaauccggguacgugacaguggcccauaccggacagcacgaucucgucauucccccuaacggcuauuuucgcuucgacucuugggugaaccaauucuacacgcuggcucccauggggaauggcaccggacggagacgcuga

SEQ ID NO: 29942 - RNA, 1617 nt, Artificial Sequence
  derived and/or modified sequence opt5 from VP1__Norovirus_and/or_Norovirus-like__AB972529
augaagauggccagcuccgacgcuaaccccucugauggcagcgccgcgaaucuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucgggacuuugaagccaaucagaacaccaaauucacacccguuggggugauccaggauggauccaccacacaucgcaaugagccccaacaguggguccucccuagcuacucuggcagaaacacgccgaaugugcaccuggcucccgccguggcgccuaccuuucccggcgaacagcuucuguucuuucgguccacaaugccuggguguagcggauaucccaacauggaccucgauugccugcugccucaggaguggguucaauacuucuaucaggaggcugcccccgcccagucugacgucgcucuccugagauuugugaauccggauaccggccgcgugcuuuucgaauguaagcugcacaaaagcggguacgucacaguggcccauaccggacagcacgaccucguuauuccucccaacggcuauuuucgguucgauuccugggugaaucaauucuacacgcuggcuccuauggggaacggcaccggaagacgccgguga

SEQ ID NO: 29943 - RNA, 1617 nt, Artificial Sequence
  derived and/or modified sequence opt5 from VP1__Norovirus_and/or_Norovirus-like__AB972504
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucacagucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaaccccugcgccccugggcacgccggacuucguugggaaaauucagggagugcuuacccagacaacccggacagacggcuccacccgcgggcacaaggccacggucuacacaggaucugcugauuuugccccuaagcugggcagagugcaauucgagaccgacaccgaucaugacuuugaagccaaccagaauacaaaauucacccccguuggggugauccaggauggaagcacaacgcaccggaacgagccccaacaguggguccucccuuccuacagcggccgcaauaccccgaacgugcaccuggcucccgccguggcgccuacauuucccggcgaacagcuucuguucuuuagaucuaccaugccuggguguuccggauaucccaauauggaccucgauugccugcugccucaggaguggguucaauacuucuaucaggaggcugcccccgcccagagcgacgucgcucuccugcgguuugugaacccggauacaggcagagugcuuuucgaauguaagcugcauaaaucuggguacgucaccguggcccacacgggacagcaugaccucguuaucccucccaauggcuauuuucgcuucgauagcugggugaaccaauucuacacccuggcuccuauggggaacggcacaggacggagacgcuga

SEQ ID NO: 29944 - RNA, 1617 nt, Artificial Sequence
  derived and/or modified sequence opt5 from VP1__Norovirus_and/or_Norovirus-like__AB972503
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucacagucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaaccccugcgccccugggcacgccggacuucguugggaaaauucagggagugcuuacccagacaacccggacagacggcuccacccgcgggcacaaggccacggucuacacaggaucugcugauuuugccccuaagcugggcagagugcaauucgagaccgacaccgaucgggacuuugaagccaaccagaauacaaaauucacccccguuggggugauccaggauggaagcacaacgcaucgcaacgagccccaacaguggguccucccuuccuacagcggcagaaauaccccgaacgugcaccuggcucccgccguggcgccuacauuucccggcgaacagcuucuguucuuucggucuaccaugccuggguguuccggauaucccaauauggaccucgauugccugcugccucaggaguggguucaauacuucuaucaggaggcugcccccgcccagagcgacgucgcucuccugagauuugugaacccggauacaggccgcgugcuuuucgaauguaagcugcacaaaucuggguacgucaccguggcccauacgggacagcacgaccucguuaucccucccaauggcuauuuucgguucgauagcugggugaaccaauucuacacccuggcuccuauggggaacggcacaggaagacgccgguga

SEQ ID NO: 29945 - RNA, 1617 nt, Artificial Sequence
  derived and/or modified sequence opt5 from VP1__Norovirus_and/or_Norovirus-like__KP244322
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuagagaugacguuuucaccguguccugccgggugcugacacgcccuagcccggauuuugacuucauuuuucucgugcccccuaccgucgaaucuagaacgaaacccuucuccguuccugugcugaccgucgaggaaaugacaaauagccgguuucccaucccgcuugagaagcuguucaccggcccuucuuccgccuucgugguucagccccagaacgggcgcuguacaaccgauggagugcuccugggcacgacacaacugagcccugucaauauuugcaccuuuagaggggacgugacacauaucucuggaucccggaacuacaccaugaaucucgccagccagaacuggaacuccuaugaucccaccgaggaaaucccugcuccccugggcacaccggacuucgucggcaaaauucagggggugcuuacgcagaccacacgcaccgacggaucuacaagaggccacaaggcgaccguuuacacggggagcgccgauuuuuccccuaagcugggacgggugcaauucgcuacagacaccgauaaugacuuugagaccaaucagaacacaaaauucacccccgucggcgugauccaggaugggggaacaacgcaucgcaaugaaccccaacaguggguucucccuaacuacagcggcagaaauacccacaacgugcaccuggccccggccgucgcucccacauuuccuggcgagcagcuucuguucuuucggucuaccaugcccggguguuccggauauccuaauauggaccucgauugccugcugccccaggaaugggugcaauacuucuaucaggaggccgcgccugcucagagcgacguggcccuccugagauuuguuaaccccgauacaggccgcguccuuuucgaguguaagcugcauaaaucuggguacgugaccguggcccacacgggacagcaugaccucgucauuccgccuaacggcuauuuucgguucgauagcugggugaaucaauucuacacccuggcucccauggggaacggcacaggaagacgccgguga

SEQ ID NO: 29946 - RNA, 1617 nt, Artificial Sequence
  derived and/or modified sequence opt5 from VP1__Norovirus_and/or_Norovirus-like__LC018706
augaagauggccagcuccgacgcuaaccccucugauggcagcgccgcgaaucuggugccugaggucaacaaugaagacauggcucucgagccgguugugggggccgccaucgcugcccccguggcuggacagcaaaacgucauugauccuuggaucagaaauaacuucgugcaggcccccggcggggaauuuaccguuuccccucggaaugcgcccggagagauucuguggucugccccucuuggcccggaccugaaccccuaccucagccaccuggcucgcauguauaauggguacgccggaggcuucgaagugcaggucauccuugcuggcaacgccuuuacagcggggaaagugauuuucgccgcuguuccucccaauuuuccuacggagggacugucccccucucaggugaccauguucccgcauaucgucguggaugugagacaacucgagccuguccugaucccccugccugacguucggaacaauuuuuaucacuacaaccagagcaaugaucccacaauuaagcucaucgccaugcuguauacaccccuucgcgcuaacaacgccggcgacgauguguucaccguguccugcagaguccugacccggccuagcccggacuuugauuucauuuuucucgugcccccuacaguugaaucucgcaccaaacccuucuccgugccuguccugacgguggaggaaaugaccaauagcagauuucccaucccgcuugagaagcuguucacagggccuucuuccgccuucguugugcagccccagaacggacgguguaccacagacggcguccuccuggggaccacgcaacugagcccugugaauauuugcacauuucgcggagaugucacccauaucacaggcucuagaaacuacaccaugaaucucgcuucccagaacuggaauaacuaugaccccaccgaggaaauuccugcgccccugggcacaccggacuucguggggaaaauccagggaguucuuacgcagaccacacggaccgauggcagcacacgcgggcacaaggccaccguguacacgggauccgcuaauuuuucuccuaagcugggcagaguccaauucgagacagacaccgaucaugacuuugaagugaaccagaauaccaaauucacacccguuggggugauccaggauggaggcaccacacaccggaacgagccccaacaguggguccucccuagcuacuccggccgcaauacgccgaacgugcaccuggcccccgccguggcuccuaccuuucccggggaacagcuucuguucuuuagaagcacaaugccuggauguucuggcuaucccaauauggaccucgauugccugcugccucaggaguggguucaauacuucuaucaggaggccgcgcccgcucaguccgacgucgcccuccugcgguuugugaacccggauaccgggagagugcuuuucgaauguaagcugcauaaaagcggauacgucacaguggcccacaccggccagcaugaccucguuauuccucccaacggguauuuucgcuucgauucuugggugaaucaauucuacacgcuggcuccuaugggcaacggaaccggccggagacgcuga

SEQ ID NO: 29947 - RNA, 1617 nt, Artificial Sequence
  derived and/or modified sequence opt5 from VP1__Norovirus_and/or_Norovirus-like__KP096345
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggggcaauuaugaucccaccgaggaaauuccugcgccccuggggacaccggacuucguuggaaaaauccagggcgugcuuacgcagaccacacggaccgacgggagcacacgcggacacaaggccaccgucuacacgggcuccgcugauuuugccccuaagcuggggagagugcaauucgagacagacaccgaucaugacuuugaagccaaccagaauaccaaauucacacccguuggagugauccaggauggcucuaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggaccucgauugccugcugccucaggaguggguucaauacuucuaucaggaggcugcccccgcccaguccgacgucgcucuccugcgguuugugaacccggauaccgggagagugcuuuucgaauguaagcugcauaaaagcggauacgucacaguggcccacaccggccagcaugaccucguuauuccucccaauggguauuuucgcuucgauucuugggugaaccaauucuacacgcuggcuccuaugggcaacggaaccggccggagacgcuga

SEQ ID NO: 29948 - RNA, 1617 nt, Artificial Sequence
  derived and/or modified sequence opt5 from VP1__Norovirus_and/or_Norovirus-like__KM982939
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggaaugcuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauccaggauggaagcaccacacaccggaacgagccccaacagugggugcucccuuccuacagcggccgcaauacgccgaacguccaccuggcucccgccguggcgccuaccuuucccggcgaacagcuucuguucuuuagaucuacaaugccuggguguuccggauaucccaauauggaccucgauugccugcugccucaggagugggugcaauacuucuaucaggaggcugcccccgcccagagcgacguugcucuccugcgguuugucaacccggauaccggcagagugcuuuucgaauguaagcugcauaaaucuggguacgugacagucgccuauaccggacagcacgaccucgugauuccucccaauggcuacuuucgcuucgauagcuggguuaaccaauucuauacgcuggcuccuauggggaacggcaccggacggagacgcuga

SEQ ID NO: 29949 - RNA, 1617 nt, Artificial Sequence
  derived and/or modified sequence opt5 from VP1__Norovirus_and/or_Norovirus-like__KM198588
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggcccugccuucuuacagcggaagagaugugcacaacguucaucuugcuccggccguggcgcccacauuuccuggcgagcagcuccuguucuuucgguccaccaugcccggguguagcggauauccuaauauggaccuggauugccugcucccccaggaguggguccagcacuucuaccaagaagcugccccugcccagucugacguggcucugcuucgcuuugugaaccccgauacaggcagaguucuguucgaguguaaacuccauaaguccggguaugucaccguggcccacacgggccagcacgaccuggugaucccgccuaauggauacuuucgguucgauagcugggucaaccaguucuauacccuugcucccaugggcaacgggacaggaagacgccgguga

SEQ ID NO: 29950 - RNA, 1617 nt, Artificial Sequence
  derived and/or modified sequence opt5 from VP1__Norovirus_and/or_Norovirus-like__KM198544
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcaucucaucgucgacgugagacaacuggagccugugcugauuccccucccugauguccggaacaauuuuuaucacuacaaccagagcaaugaccccaccaucaagcugauugcuaugcuuuauacaccccugcgcgccaacaacgcuggcgaugacguuuucaccguguccugcagagugcucacacggccuagcccggauuuugacuucaucuuucuggugcccccuaccgucgaaucucgcacgaaacccuucuccguuccugugcuuaccgucgaggaaaugacaaauagcagauuucccauuccgcuggagaagcuguucaccgggccuucuuccgccuucgugguucagccccagaacggacgguguacaaccgauggcgugcugcuggggacgacacaacucagcccugucaauaucugcaccuuucgcggagacgugacacauauuucuggcuccagaaacuacaccaugaaucuggccagccagaacuggaacuccuaugaucccaccgaggaaaucccugcuccccuuggcacaccggacuucgucgggaaaauccagggagugcugacgcagaccacacggaccaauggcucuacacgcgggcacaaggcgaccguuuacacgggaagcgccgacuuuuccccuaagcucggcagagugcaauucgcuacagauaccgacaaugauuuugagaccaaccagaauacaaaauucacccccgucggggugauucaggacggaagcacaacgccccggaacgaaccucaacaguggguucugccgucuuacuccggccgcaauauccauaacgugcaccuugcccccgccgucgcuccuaccuuucccggcgagcagcuccucuucuuuagaagcacaaugccuggguguucuggauaucccaauauggaucuggacugccugcucccucaggaaugggugcaauacuucuaucaggaggccgcgcccgcucagagcgauguggcccugcuucgguuuguuaacccggacaccggcagaguccuguucgaguguaagcuccacaaauccggguacgugacaguggcccauaccggacagcacgaucuggucauuccucccaacggcuauuuucgcuucgacucuugggugaaucaauucuacacgcuugcuccuauggggaacggcaccggacggagacgcuga

SEQ ID NO: 29951 - RNA, 1617 nt, Artificial Sequence
  derived and/or modified sequence opt5 from VP1__Norovirus_and/or_Norovirus-like__KM198522
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucagagugauccuugcuggcaacgccuuuacagcggggaaaauuaucuucgccgcuguuccucccaauuuuccuacggagggacugucccccucucaggugaccauguucccgcauaucauugucgacgugcggcagcucgagccugugcugaucccccugccugauguccgcaacaauuuuuaucacuacaaccaaacaaaugacagcaccauuaagcucaucgccaugcuguauacaccccuuagagcuaacaacgccggcgaagauguuuucaccguguccugccgggugcugacacgccccagcccugacuuugauuucauuuuucucgucccgcccaccguggagucuagaacgaaaccuuucaccguucccauccugacaguggaagagaugaccaauucccgguuuccuauuccccuugagaagcuguucacagggccgagcggagccuucgucgugcagccucagaacggccgcuguaccacggacgggguucuccugggaacaacccagcugucucccgugaauaucugcacauuuagaggcgaugucacccauaucgcuggcucccggaacuacaccaugaaucucgcgagccugaacuggaauaacuaugacccuacagaagagauucccgccccucuugggacgcccgauuucgugggaaaaauccaaggcguccugacccagacaaccaagggggacggaucuacacgcggccacaaggcuaccguguacacgggguccgccccguuuacaccuaaacucggaagcguucaguucuccaccgacaccgaaaaugauuuugagacacaucagaacaccaaguucacacccgugggcgucauucaagacggcgggacgacccacagaaaugaaccccagcagugggugcugccuucuuacagcggacgggauguucacaacgugcaucuugccccggcugucgcccccacauuuccuggcgagcaacuccuguucuuucgcuccaccaugcccggguguagcggauauccuaauauggaccuggauugccugcucccccaggagugggugcagcacuucuaccaggaagcggcuccugcccaaucugacguggcccugcuuagauuuguuaaccccgauacaggccggguccuguucgaguguaaacuccauaaguccggguaugugaccguggcucacacgggccagcacgaccuggucaucccgccuaauggauacuuuagauucgauagcugggugaaccaguucuauacccuugcccccaugggcaacgggacaggacgccggagauga

SEQ ID NO: 29952 - RNA, 1617 nt, Artificial Sequence
  derived and/or modified sequence opt5 from VP1__Norovirus_and/or_Norovirus-like__KM198508
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagagauguucacaacgugcaucuugccccggcugucgcccccacauuuccuggcgagcagcuccuguucuuucgguccaccaugcccggguguagcggauauccuaauauggaccuggauugccugcucccccaggagugggugcagcacuucuaccaagaagcggcuccugcccagucugacgccgcucugcuucgcuuugugaaccccgauacaggcagaguucuguucgaguguaaacuccauaaguccggguaugucaccguggcccacacgggccagcacgaccuggugaucccgccuaauggauacuuucgguucgauagcugggucaaccaguucuauacccuugcucccaugggcaacgggacaggaagacgccgguga

SEQ ID NO: 29953 - RNA, 1617 nt, Artificial Sequence
  derived and/or modified sequence opt5 from VP1__Norovirus_and/or_Norovirus-like__KJ716367
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcaucgugcaauucgagacagacaccgaucaugacuuugaagccaaccagaauaccaaauucacacccguuggggugauucaggauggaagcaccacacacagaaacgagccccaacaguggguccucccuuccuacagcggccggaauacgccgaacgugcaccuggcucccgccguggcgccuaccuuucccggcgaacagcuucuguucuuucgcucuacaaugccuggguguuccggauaucccaauauggaccucgauugccugcugccucaggaguggguucaauacuucuaucaggaggcugcccccgcccagagcgacgucgcucuccugagauuugugaacccggauaccggccgggugcuuuucgaauguaagcugcauaaaucuggguacgucacaguggcccacaccggacagcaugaccucguuaucccucccaauggcuauuuuagauucgauagcugggugaaccaauucuacacgcuggcuccuauggggaacggcaccggacgccggagauga

SEQ ID NO: 29954 - RNA, 1617 nt, Artificial Sequence
  derived and/or modified sequence opt5 from VP1__Norovirus_and/or_Norovirus-like__KF177440
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgccgaaugugcaccuggcucccgccguggcgccuaccuuucccggggaacagcuucuguucuuuagauccacaaugccuggauguagcggcuaucccucuauggaccucgauugccugcugccucaggaguggguucaauacuucuaucaggaggcugcccccgcccaguccgacgucgcucuccugcgguuugugaacccggauaccgggagagugcuuuucgaauguaagcugcauaaaagcggauacgucacaguggcccacaccggccagcaugaccucguuauuccucccaauggguauuuucgcuucgauucuugggugaaccaauucuacacgcuggcuccuaugggcaacggaaccggccggagacgcuga

SEQ ID NO: 29955 - RNA, 1617 nt, Artificial Sequence
  derived and/or modified sequence opt5 from VP1__Norovirus_and/or_Norovirus-like__KF060117
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucauugucgacgugagacaacucgagccugugcugaucccccugccugauguccggaauaacuuuuaucauuacaaucagagcaacgaccccaccauuaagcucaucgcuaugcuguauacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacacaucucuggcuccagaaauuacaccaugaaccucgccagccagaauuggaacuccuaugaucccaccgaggaaaucccugcuccccugggcacaccggacuucgucgggaaaauucagggagugcuuacgcagaccacacggaccgacggcucuacacgcgggcauaaggcgaccguuuacacgggaagcgccgauuuuuccccuaagcugggcagagugcaauucgcuacagacaccgauaaugacuuugucaccaaccagaauacaaaauucacccccguggggguuauccaggauggaagcacaacgccccggaacgagccucaacagugggugcucccgucuuacuccggccgcaauacccacaacguccaccuggcccccgccguggcuccuacauuucccggcgaacagcuucuguucuuuagaagcaccaugccuggguguucuggauaucccaauauggaccucgauugccugcugccucaggagugggugcaauacuucuaucaggaagccgcgcccgcucagagcgacguugcccuccugcgguuugucaacccggauacaggcagagugcuuuucgaguguaagcugcauaaauccggguacgugaccgucgcccacacgggacagcaugaccucgugauuccucccaauggcuauuuucgcuucgauucuuggguuaaccaauucuacacccuggcuccuauggggaacggcacaggacggagacgcuga

SEQ ID NO: 29956 - RNA, 1617 nt, Artificial Sequence
  derived and/or modified sequence opt5 from VP1__Norovirus_and/or_Norovirus-like__KF060104
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccuccuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauaucuccggcagcagaaauuacaccaugaaccucgccucccagaauuggaacucuuaugaucccaccgaggaaaucccugcuccccugggcacaccggacuucgucgggaaaauucagggagugcuuacgcagaccacacggaccgacggcagcacacgcgggcacaaggcgaccguuuacacgggauccgccgauuuuagcccuaagcugggcagagugcaauucgcuacagacaccgauaaugacuuugucaccaaccagaauacaaaauucacccccguggggguuauccaggauggaucuacaacgccccggaacgagccucaacagugggugcucccguccuacagcggccgcaauacccauaacguccaccuggcccccgccguggcuccuacauuucccggcgaacagcuucuguucuuuagaucuaccaugccuggguguagcggauaucccaauauggaccucgauugccugcugccucaggagugggugcaauacuucuaucaggaagccgcgcccgcucaguccgacguugcccuccugcgguuugucaacccggauacaggcagagugcuuuucgaguguaagcugcacaaaucuggguacgugaccgucgcccauacgggacagcacgaccucgugauuccucccaauggcuauuuucgcuucgauagcuggguuaaccaauucuacacccuggcuccuauggggaacggcacaggacggagacgcuga

SEQ ID NO: 29957 - RNA, 1617 nt, Artificial Sequence
  derived and/or modified sequence opt5 from VP1__Norovirus_and/or_Norovirus-like__KF060095
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuggagccuucgugguucagccccagaacggccgguguacaaccgauggggugcuccugggaacgacacaacuguccccugucaauauuugcaccuuucgcggcgacgugacacauaucagcggcucuagaaacuacaccaugaaucucgccucccagaacuggaauagcuaugaucccaccgaggaaaucccugcuccccuggggacaccggacuucgucggaaaaauucagggcgugcuuacgcagaccacacggaccgacggguccacacgcggacacaaggcgaccguuuacacgggcucugccgauuuuagcccuaagcuggggagagugcaauucgcuacagacaccgauuccgacuuugucaccaaccagaauacaaaauucacccccgugggaguuauccaggauggcagcacaacgccccggaacgagccucaacagugggugcucccgucuuacuccggccgcagcacccauaauguccaccuggcccccgccguggcuccuacauuucccggggaacagcuucuguucuuuagaucuaccaugccuggauguagcggcuaucccaacauggaccucgauugccugcugccucaggagugggugcaauacuucuaucaggaagccgcgcccgcucaguccgacguugcccuccugcgguuugucaauccggauacagggagagugcuuuucgaguguaagcugcacaaaucuggauacgugaccgucgcccauacgggccagcacgaccucgugauuccucccaacggguauuuucgcuucgauagcuggguuaaucaauucuacacccuggcuccuaugggcaacggaacaggccggagacgcuga

SEQ ID NO: 29958 - RNA, 1617 nt, Artificial Sequence
  derived and/or modified sequence opt5 from VP1__Norovirus_and/or_Norovirus-like__KF060084
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucaccaaucagaacacaaaauucacccccguggggguuauccaggauggaagcacaacgccccggaaugagccucaacagugggugcucccgucuuacuccggccgcaacacccauaauguccaccuggcccccgccguggcuccuacauuucccggcgaacagcuucuguucuuuagaagcaccaugccuggguguucuggauaucccaacauggaccucgauugccugcugccucaggagugggugcaauacuucuaucaggaagccgcgcccgcucagagcgacguugcccuccugcgguuugucaauccggauacaggcagagugcuuuucgaguguaagcugcacaaauccggguacgugaccgucgcccauacgggacagcacgaccucgugauuccucccaacggcuauuuucgcuucgauucuuggguuaaccaauucuacacccuggcuccuauggggaauggcgccggacggagacgcuga

SEQ ID NO: 29959 - RNA, 1617 nt, Artificial Sequence
  derived and/or modified sequence opt5 from VP1__Norovirus_and/or_Norovirus-like__KF060082
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaaagcggguacgugacaguggcccauaccggacaguaugaucucgucauucccccuaacggcuacuuucgcuucgacuccugggugaaucaauucuauacgcuggcucccauggggaacggcaccggacggagacgcuga

SEQ ID NO: 29960 - RNA, 1617 nt, Artificial Sequence
  derived and/or modified sequence opt5 from VP1__Norovirus_and/or_Norovirus-like__KF060079
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacugguccucuuaugaucccaccgaggaaaucccugcuccccugggcacaccggacuucgucgggaaaauucagggagugcuuacgcagaccacacggaccgacggcagcacacgcgggcacaaggcgaccguuuacacgggauccgccgauuuuagcccuaagcugggcagagugcaauucgcuacagacaccgauaaugacuuugucaccaaccagaauacaaaauucacccccguggggguuauccaggauggaucuacaacgccccggaacgagccucaacagugggugcucccguccuacagcggccgcaauacccauaacguccaccuggcccccgccguggcuccuacauuucccggcgaacagcuucuguucuuuagaucuaccaugccuggguguagcggauaucccaauauggaccucgauugccugcugccucaggagugggugcaauacuucuaucaggaagccgcgcccgcucaguccgacguugcccuccugcgguuugucaacccggauacaggcagagugcuuuucgaguguaagcugcacaaaucuggguacgugaccgucgcccauacgggacagcacgaccucgugauuccucccaauggcuauuuucgcuucgauagcuggguuaaccaauucuacacccuggcuccuauggggaacggcacaggacggagacgcuga

SEQ ID NO: 29961 - RNA, 1617 nt, Artificial Sequence
  derived and/or modified sequence opt5 from VP1__Norovirus_and/or_Norovirus-like__KF060058
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccucuacgauucuguggagcgcgccucuuggaccggaucugaaccccuaccucucccaccuggcccgcauguauaauggcuacgcugggggauucgagguccaggugauccuugccggcaacgcuuuuaccgccggcaaaauuaucuucgcggccguuccucccaauuuuccuacagaagggcugucucccagccaggugaccauguucccgcauaucauugucgacgugagacaacucgagccugugcugaucccccugccugauguccggaacaauuuuuaucacuacaaccaguccaaugaccccacaauuaagcucaucgcuaugcuguauacaccccuucgcgccaacaacgcuggagaugacguuuucaccgugagcugcagagugcugacccggccuucuccggauuuugacuucauuuuucucgugcccccuacggucgagucccgcaccaaacccuucagcguuccugugcugacagucgaagagaugaccaauucuagauuucccaucccgcuugaaaagcuguucacaggcccuuccagcgccuucgugguucagccccagaacgggcgguguaccacggauggagugcuccugggcacaacccaacugucuccugucaauauuugcacauuucgcggggacgugacccauaucuccggaagcagaaacuacaccaugaaucucgccucccagaacuggaacucuuaugaucccacagaggagaucccugcuccccugggcacgccggacuucgucggcaaaauucagggggugcuuacccagacaacccggacagacggaagcacccgcggccacaaggcgacgguuuacacaggguccgccgauuuuagcccuaagcugggaagagugcaauucgcuaccgacaccgauaaugacuuugucacaaaucagaacaccaaauucacacccgugggcguuauccaggaugggucuacgacaccccggaaugaaccucaacagugggugcucccguccuacagcggacgcaacauucauaauguccaccuggcccccgccguggcuccuaccuuucccggcgagcagcuucuguucuuuagaucuaccaugccuggcuguagcggguaucccaacauggaccucgauugccugcugccucaggaaugggugcaauacuucuaucaggaggccgcgcccgcucaguccgacguugcccuccugcgguuugucaauccggauacaggaagagugcuuuucgaauguaagcugcacaaaucuggcuacgugaccgucgcccauacggggcagcacgaccucgugaucccucccaacggauauuuucgcuucgauagcuggguuaaccaauucuacacccuggcuccuaugggcaaugggacaggccggagacgcuga

SEQ ID NO: 29962 - RNA, 1617 nt, Artificial Sequence
  derived and/or modified sequence opt5 from VP1__Norovirus_and/or_Norovirus-like__KF060039
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcuccgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauaucuccggcagcagaaauuacaccaugaaccucgccucccagaauuggaacucuuaugaucccaccgaggaaaucccugcuccccugggcacaccggacuucgucgggaaaauucagggagugcuuacgcagaccacacggaccgacggcagcacacgcgggcacaaggcgaccguuuacacgggauccgccgauuuuagcccuaagcugggcagagugcaauucgcuacagacaccgauaaugacuuugucaccaaccagaauacaaaauucacccccguggggguuauccaggauggaucuacaacgccccggaacgagccucaacagugggugcucccguccuacagcggccgcaauacccauaacguccaccuggcccccgccguggcuccuacauuucccggcgaacagcuucuguucuuuagaucuaccaugccuggguguagcggauaucccaauauggaccucgauugccugcugccucaggagugggugcaauacuucuaucaggaagccgcgcccgcucaguccgacguugcccuccugcgguuugucaacccggauacaggcagagugcuuuucgaguguaagcugcacaaaucuggguacgugaccgucgcccauacgggacagcacgaccucgugauuccucccaauggcuauuuucgcuucgauagcuggguuaaccaauucuacacccuggcuccuauggggaacggcacaggacggagacgcuga

SEQ ID NO: 29963 - RNA, 1617 nt, Artificial Sequence
  derived and/or modified sequence opt5 from VP1__Norovirus_and/or_Norovirus-like__KF060030
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggaacgccccucuuggcccggaucugaaucccuaccucucucaccuggcucgcauguauaacggguacgccggaggcuucgaaguccaggugauccuugcuggcaaugccuuuacagcggggaaaguuauuuucgccgcugugccucccaacuuuccuacggagggacugagccccucccaggucaccauguucccgcauaucgugguggacgucagacaacucgagccuguucugaucccccugccugaugugcggaauaacuuuuaucacuacaaucagucuaacgaccccacaauuaagcucaucgccaugcuguauacaccccuucgcgcuaacaaugccggcgaugacguguucaccgucagcugcagagugcugacccggccuuccccggauuuugacuucauuuuucucguucccccuacaguggaaagccgcaccaaacccuucucugucccugugcugacgguugaggaaaugaccaacuccagauuucccaucccgcuugagaagcuguucacagggccuagcucugccuucgugguccagccccagaauggacgguguaccacagauggcgugcuccuggggaccacgcaacuguccccugucaacauuugcacauuucgcggagacgugacccauaucacaggcagcagaaauuacaccaugaaccucgcuucucagaauuggaacaauuaugaucccaccgaggaaauuccugcgccccugggcacaccggacuucguugggaaaauccagggagugcuuacgcagaccacacggaccgacggcuccacacgcgggcacaaggccaccgucuacacgggaagcgcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuuccuacucuggccgcaauacgcacaacgugcaucuggcuccggccguggcgcccaccuuuccuggggaacagcuucuguucuuuagaagcacaaugcccggauguuccggcuauccuaauauggaccucgauugccugcugccccaggaguggguucaauacuucuaucaggaggcugccccugcccagagcgacgucgcucuccugcgguuugugaaccccgauaccgggagagugcuuuucgaauguaagcugcacaaaucuggauacgccacagucgcucauaccggccagcacgaccucgugauuccgccuaacggguauuuucgcuucgauuccuggguuaaucaauucuacacgcuggcccccaugggcaacggaaccggccggagacgcuga

SEQ ID NO: 29964 - RNA, 1617 nt, Artificial Sequence
  derived and/or modified sequence opt5 from VP1__Norovirus_and/or_Norovirus-like__JX439829
augaagaugggcagcaacgacgccaaucccuccgaugggucuaccgcuaaccuggugccugaggucaauaacgaaguuauggcccucgagccgguggugggagcggcuaucgccgcccccgucgcuggccagcaaaaugugaucgacccuuggaucagaaacaauuucguucaggcccccgggggagaauuuacagugagcccucggaacgcucccggcgagauucugugguccgccccucuugggccggaucugaaucccuaccucucucaccuggcgcgcauguauaacggauacgccggcggcuucgaaguccaggugauccuugcugggaaugccuuuacggcuggaaaaauuaucuucgccgcgguuccucccaacuuuccuaccgagggccugagccccucccaggugacaauguucccgcauaucauugucgacgugagacaacucgagccugugcugaucccccugccugauguccggaauaacuuuuaucacuacaaucagucuaacgaccccaccauuaagcucaucgccaugcuguauacaccccuucgcgcuaacaaugccggggaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaacuccagauuucccaucccgcuugagaagcuguucaccggaccuagcucugcuuucgugguucagccccagaauggccgguguacaaccgauggggugcuccugggaacgacacaacuguccccugucaacauuugcaccuuucgcggcgacgugacacauauccccggcagcagaaauuacaccaugaaccucgccucucagaauuggaacuccuaugauccuaccgaggaaauccccgccccgcuggggacaccugacuucgucggaaaaauucagggcgugcuuacgcagaccacacggaccaaugggagcacacgcggacacaaggcuaccguuuacacgggcuccgcggacuuuucucccaagcuggggagagugcaauucgccacagauaccgacaacgauuuugagaccaaucagaacacaaaauucacccccgucggagugauccaggacggcagcacaacgccucggaaugaaccgcaacaguggguucuccccuccuacagcggccgcaacauucauaaugugcaccuggcuccugccgucgcccccaccuuuccuggggagcagcuucuguucuuuagaucuacaaugcccggauguuccggcuauccuaacauggaucucgacugccugcugccccaggaaugggugcaauacuucuaucaggaggcugccccggcgcagagcgauguggcucuccugcgguuuguuaacccugacaccgggagaguccuuuucgaguguaagcugcacaaaucuggauacgugacaguggcccauaccggccagcacgaucucgucauucccccuaauggguauuuucgcuucgacagcugggugaaccaauucuacacgcuggcccccaugggcaauggaaccggccggagacgcuga

SEQ ID NO: 29965 - RNA, 1617 nt, Artificial Sequence
  derived and/or modified sequence opt5 from VP1__Norovirus_and/or_Norovirus-like__KC409282
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagacgcccgccccucuugggacccccgauuucgugggaaaaauucagggcguccugacacagaccacaaagggggacggaucuacccggggccacaaggcuacgguguacacaggguccgccccguuuaccccuaaacucggaagcguucaguucuccaccgacacagaaaaugauuuugagacccaucaaaacacaaaguucacgcccgugggcgucauccaggacggcgggaccacacaccgcaaugaaccccagcaaugggugcugccuucuuacagcggaagagauguucacaacgugcaucuugccccggcugucgcccccaccuuuccuggcgagcagcuccuguucuuucgguccacaaugcccggguguagcggauauccuaauauggaccuggauugccugcucccccaggagugggugcagcacuucuaccaagaagcggcuccugcccagucugacguggcccugcuucgcuuuguuaaccccgauaccggcagaguccuguucgaguguaaacuccauaaguccggguaugugacgguggcucacaccggccagcacgaccuggucauuccgccuaauggauacuuucgguucgauagcugggugaaccaguucuauacacuugcccccaugggcaacgggaccggaagacgccgguga

SEQ ID NO: 29966 - RNA, 1617 nt, Artificial Sequence
  derived and/or modified sequence opt5 from VP1__Norovirus_and/or_Norovirus-like__KC409259
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagagauguucacaacgugcaucuugccccggcugucgcccccacauuuccuggcgagcagcuccuguucuuucgguccaccaugcccggguguagcggauauccuaauauggaccuggauugccugcucccccaggagugggugcagcacuucuaccaagaagcggcuccugcccagucugacguggcccugcuucgcuuuguuaaccccgauacaggcagaguccuguucgaguguaaacuccauaagccgggguaugugaccguggcucacacgggccagcacgaccuggucaucccucccaauggauacuuucgguucgauuccugggugaaccaguucuauacccuugccccuaugggcaacgggacaggaagacgccgguga

SEQ ID NO: 29967 - RNA, 1617 nt, Artificial Sequence
  derived and/or modified sequence opt5 from VP1__Norovirus_and/or_Norovirus-like__JX459659
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucgucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuguccugaccguggaggaaaugacaaauagcagauuucccauuccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauuucuggcuccagaaacuacaccaugaaucucgccagccagaacuggaacuccuaugaucccaccgaggaaaucccugcuccccugggcacaccggacuucguggggaaaauccagggaguucuuacgcagaccacacggaccgacggcucuacacgcgggcacaaggcgaccguguacacgggaagcgccgauuuuuccccuaagcugggcagaguccaauucgcuacagacaccgauaaugacuuugugaccaaucagaacacaaaauucacccccguuggggugauucaggauggaagcacaacgccccggaaugagccucaacaguggguccucccgucuuacuccggccgcaacacccauaaugugcaccuggcccccgccguggcuccuacauuucccggcgaacagcuucuguucuuuagaagcaccaugccuggguguucuggauaucccaacauggaccucgauugccugcugccucaggaguggguucaauacuucuaucaggaagccgcgcccgcucagagcgacgucgcccuccugcgguuugugaauccggauacaggcagagugcuuuucgaguguaagcugcacaaauccggguacgucaccguggcccauacgggacagcacgaccucguuaucccucccaacggcuauuuucgcuucgauucuugggugaaccaauucuacacccuggcuccuauggggaauggcacaggacggagacgcuga

SEQ ID NO: 29968 - RNA, 1617 nt, Artificial Sequence
  derived and/or modified sequence opt5 from VP1__Norovirus_and/or_Norovirus-like__JX459658
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucauugugcagccccagaacggacgguguacaaccgauggcguucuccuggggacgacacaacugagcccugugaauaucugcaccuuucgcggagacgucacacauaucucuggcuccagaaacuacaccaugaaucucgccagccagaacuggaacuccuaugaucccaccgaggaaauuccugcuccccugggcacaccggacuucguggggaaaauccagggaguccuuacgcagaccacacggaccgacggcucuacacgcgggcacaaggcgaccguguacacgggaagcgccgauuuuuccccuaagcugggcagaguucaauucgcuacagacaccgauaaugacuuugugaccaaucagaacacaaaauucacccccgucggggugauucaggauggaagcacaacgccccggaaugagccucaacaguggguucucccgucuuacuccggccgcaacacccauaaugugcaccuggcccccgccgucgcuccuacauuucccggcgaacagcuucuguucuuuagaagcaccaugccuggguguucuggauaucccaacauggaccucgauugccugcugccucaggagugggugcaauacuucuaucaggaagccgcgcccgcucagagcgacguggcccuccugcgguuuguuaauccggauacaggcagaguccuuuucgaguguaagcugcacaaauccggguacgugaccguggcccauacgggacagcacgaccucgucaucccucccaacggcuauuuucgcuucgauucuugggugaaccaauucuacacccuggcuccuauggggaauggcacaggacggagacgcuga

SEQ ID NO: 29969 - RNA, 1617 nt, Artificial Sequence
  derived and/or modified sequence opt5 from VP1__Norovirus_and/or_Norovirus-like__JX459595
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugacagcacaauuaagcucauccccaugcuguauacaccccuucgcgcuaacaacgccggcgaugacguuuucaccguguccugcagagugcugacccggccuagcccggauuuugacuucauuuuucucgugcccccuacggucgaaucucgcaccaaacccuucuccguuccuauccugacaguggaggaaaugaccaauagcagauuucccauuccgcuugagaagcuguucacagggccuucuuccgcuuucgucgugcagccccagaacggacgguguaccacggauggcguucuccuggggacaacccaacugagcccugugaauaucugcacauuucgcggagacgucacccauaucgccggcacccagucuuacacaaugaaccucgccucccagaauuggaacaauuaugaucccacggaggaaauuccugcuccccugggcaccccggacuucguggggaaaauccagggaguccuuacacaaaccacaagaggcgacgggagcacccggggacacaaggcgacgguguccacaggcucuguucauuuuaccccuaagcuggggagcgugcaguucuccaccgauacaagcaacgacuuugagaccggacagaauacacgcuucacgcccgucggcgugguucaagauggcucuaccacacaccagaacgaaccccagcagugggugcucccuaauuacuccgggagagacagccacaacguccaucuggccccggcuguggcccccaccuuuccuggagagcaacuucuguucuuucggucuacaaugcccggcuguagcggguacccuaauaugaaccucgauugccugcugccccaggaaugggugcagcacuucuaucaggaguccgccccugcucaaucugacguugcccuccugcgcuuugucaaucccgauaccggaagagugcuuuucgaguguaaacugcauaagagcggcuacgugacggucgcgcacaccgggcagcacgaccucgugauuccgccuaacggcuauuuucgguucgauuccuggguuaaccaguucuacacacuggcucccaugggaaauggcgccgggagacgccgguga

SEQ ID NO: 29970 - RNA, 1617 nt, Artificial Sequence
  derived and/or modified sequence opt5 from VP1__Norovirus_and/or_Norovirus-like__JQ613560
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacgggcgaacggcuccacccgcgggcacaaggccacaguuuacaccggaucugcugacuuuagccccaagcugggcagagugcaauucgccacggauacagacaaugauuuugagaccaaccagaauaccaaauucacacccgucggggugauccaggacggauccaccacaccucggaacgaaccgcaacaguggguucuccccagcuacucuggccgcaauauucauaacgugcaccuggccccugcugucgcccccacguuuccuggcgagcagcuucuguucuuuagauccaccaugcccggguguagcggauauccuaauauggaucucgacugccugcugccccaggaaugggugcaauacuucuaucaggaggcggcuccggcccagucugauguggcccuccugcgguuuguuaacccugacacaggcagaguccuuuucgaguguaagcugcacaaaagcggguacgugaccguggcucauacaggacagcacgaucucgucauucccccuaacggcuauuuucgcuucgacuccugggugaaucaauucuacacccuggcccccauggggaacggcacgggacggagacgcuga

SEQ ID NO: 29971 - RNA, 1617 nt, Artificial Sequence
  derived and/or modified sequence opt5 from VP1__Norovirus_and/or_Norovirus-like__JQ613545
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauaacuaugauccuaccgaggaaauccccgcuccgcugggcacaccugacuucgucgggaaaauucagggagugcuuacgcagaccacacggaccaauggcagcacacgcgggcacaaggcgaccguuuacacgggauccgccgacuuuucucccaagcugggcagagugcaauucgcuacagauaccgacaacgauuuugagaccaaucagaacacaaaauucacccccgucggggugauccaggacggaagcacaacgccucggaaugaaccgcaacaguggguucuccccuccuacagcggccgcaacauucauaaugugcaccuggccccugccgucgcucccaccuuuccuggcgagcagcuucuguucuuuagaucuacaaugcccggguguuccggauauccuaacauggaucucgacugccugcugccccaggaaugggugcaauacuucuaucaggaggccgcgccggcucagagcgauguggcccuccugcgguuuguuaacccugacaccggcagaguccuuuucgaguguaagcugcacaaaucuggguacgugacaguggcccauaccggacagcacgaucucgucauucccccuaauggcuauuuucgcuucgacagcugggugaaccaauucuacacgcuggcucccauggggaauggcaccggacggagacgcuga

SEQ ID NO: 29972 - RNA, 1617 nt, Artificial Sequence
  derived and/or modified sequence opt5 from VP1__Norovirus_and/or_Norovirus-like__AB541288
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauuccuugguccgccccgcugggccccgaucuuaauccuuaccugucucaccucgcucgcauguauaacggguacgccggaggcuucgaaguccaggugguucuggcuggcaaugccuuuacagcggggaaagugaucuucgccgcugugcccccuaacuuucccacggagggacuuagcccgucccaggucaccauguucccucauauuaucguggacgucagacaacuggagcccguucucaucccucugcccgaugugcggaauaacuuuuaucacuacaaucagucuaacgacagcacaauuaagcugaucgccaugcucuauacaccccugcgcgcuaacaaugccggcgaagauguguucaccgucuccugcagagugcuuacccggccuagcccggacuuugauuucauuuuucugguucccccuacaguggagucucgcaccaaacccuucacggucccuauccucaccguggaagagaugacaaacuccagauuucccauuccgcuggagaaacuuuucaccgggccuagcggagccuucguugugcagccccagaauggccgguguacaaccgacgggguccugcucggaacgacacaacugucuccugugaacaucugcaccuuucgcggcgaugucacacauauugcuggcuccagaaauuacaccaugaaccuggcgagccucaauuggaacaauuaugaccccaccgaagagaucccugcuccccuggggacaccggauuucgugggaaagauccagggcguucuuacgcagaccacaaagggggacggaucuacccggggccacaaggccacaguguacaccggguccacgccuuuuacacccaaacugggaagcguccaguucuccaccgacaccgaaaacgauuuugagaaucaucaaaacacaaaguucacccccgugggcguuauucaggacggcgggacaacgcaccgcaaugaaccucagcaaugggugcucccgucuuacagcggaagaaacguccagaaugugcaccuggcccccgccguggcuccuaccuuucccggcgagcagcuucuguucuuucgguccacaaugccuggguguagcggauaucccaacauggaucucgacugccugcugccucaggaguggguucaacauuucuaccaggaagccgcgcccgcucagucugaugucgcccuccugcgcuuugugaacccggacaccggcagagugcuuuucgaguguaaacugcacaaguccggguaugucacaguggcccauaccggccagcacgaucucguuaucccucccaauggauacuuucgguucgacagcugggugaaccaauucuauacgcuggcuccuaugggcaaugggaccggaagacgccgguga

SEQ ID NO: 29973 - RNA, 1617 nt, Artificial Sequence
  derived and/or modified sequence opt5 from VP1__Norovirus_and/or_Norovirus-like__AB541247
augaagauggccagcaacgacgcuaauagauccgauggcucugccgcgaaccuggugcccgaggucaauaacgaaguuauggcucucgagccuguggugggggccgccaucgcugccccggucgcuggacagcaaaaugugauugaccccuggauccggaacaauuucguucaggccccuggcggggaauuuaccgugagcccccgcaacgcgccuggagagauucugugguccgcuccccuuggcccugaucugaauccguaccucucucaccuggccagaauguauaacggguacgccggaggcuucgaaguccaggugauccuugcuggcaaugccuuuacagcggggaaaauuaucuucgccgcuguucccccuaacuuucccacggagggacugagcccuucccaggugaccauguucccccauaucauugucgacgugcggcaacucgagccggugcugaucccucugcccgauguccgcaauaacuuuuaucacuacaaucagucuaacgacagcacaauuaagcucaucgccaugcuguauaccccucuuagagcuaacaaugccggcgaagauguuuucacaguguccugccgggugcugacccgccccagccccgacuuugauuucauuuuucucgucccuccgacaguggagucuagaaccaaacccuucacgguuccuauccugaccguggaagagaugacaaacucccgguuucccauuccucuugagaagcuguucaccgggcccagcucugccuucgucgugcagccgcagaauggacgcuguacaaccgacggcguucuccuggggacgacacaacuguccccugugaacaucugcaccuuuagaggagaugucacacauaucgcuggcagccggaauuacaccaugaaccucgcgucucugaauuggaacaauuaugaccccaccgaagagauuccugcuccccuuggcacaccugauuucguggggaaaauccagggaguccugacgcagaccacaaagggcgacggguccacccgcggacacaaggccacaguguacaccggcagcgcccccuuuacgccgaaacucggguccguucaguucucuacagacaccgaaaacgauuuugagacccaucaaaauacaaaguucaccccugugggagucauucaggacggcagcacaacgcacagauccgaaccccagcaaugggugcugcccagcuacucuggccggaacguuccuaaugugcaccuugccccggcugucgcccccaccuuuccuggggagcagcuccuguucuuucgcuccacaaugcccggauguagcggcuauccuaacauggaucuggacugccugcucccccaggagugggugcagcauuucuaccaagaagcggcuccugcccagucugauguggcccugcuuagauuuguuaaucccgacaccgggcggguccuguucgaguguaaacuccacaagagcggauaugugacaguggcucauaccggccagcacgaucuggucaucccgccuaacggguacuuuagauucgacuccugggugaaccaguucuauacgcuugcccccaugggcaauggaaccggccgccggagauga

SEQ ID NO: 29974 - RNA, 1617 nt, Artificial Sequence
  derived and/or modified sequence opt5 from VP1__Norovirus_and/or_Norovirus-like__EU839585
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaaugaccaacuccagauuuccuauuccccuugagaagcuguucacagggccgagcucugccuucgucgugcagccucagaauggacgguguaccacggauggcguucuccuggggacaacccaacugucccccgugaacaucugcacauuucgcggagacgucacccauaucccuggcaccagaacauaccggaugaaucucgccagccagaacuggaauaacuaugaucccacggaggaaauuccugcuccccugggcaccccggacuucguggggaaaauccagggaaugcuuccucagacaaccaagggcgacgggucuacacgcggacacaaggcgaccgucuccacgggcagcguggauuuuacacccaaacugggguccguucaauucgccaccgacaccgauaaugacuuugagacaggacagaacaccagauucacacccgugggcgucauucaggauggcucuagcacgcaucggaaugaaccucaacagugggugcucccggacuacuccgggcgcaccguuuacaacgugcaccuggcucccgccgucgccccuacauuucccggagagcagcuucuguucuuuagaagcaccaugccuggcuguucuggguaucccaauauggaucucgacugccugcugccucaggaaugggugcaacacuucuaccaggaggcugcccccucccagagcgauguggcgcuccugcgguuuguuaacccggacacaggaagaguccuuuucgaguguaagcugcauaaagcuggcuaugugaccguggcccacacggggcagcaugaucucgucaucccucccaauggcuacuuucgcuucgacucuugggugaaccaauucuauacccuggccccuaugggaaacggcgcugggcggagacgcuga

SEQ ID NO: 29975 - RNA, 1617 nt, Artificial Sequence
  derived and/or modified sequence opt5 from VP1__Norovirus_and/or_Norovirus-like__AY588021
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaagauucacgcccguuggcgugguccaggaugggaacggaacccaccaaaaugagccccagcagugggugcucccuuccuacagcggccggacagggcauaacguucaccuggcuccggccguggcccccaccuuuccuggagaacagcuucuguucuuucgcuccacaacccccggcuguucuggguacccuaacaugaaucucgacugccugcugccccaagaguggguccagcauuucuaucaggaggcugccccugcgcagagcgauguggcucuccugagauuugugaaccccgacacgggccggguucuuuucgaauguaagcugcacaaauccggauacgucaccguggcccacacaggccaacaugaucucgugaucccgccuaauggguauuuuagauucgacagcugggucaaccaguucuacacccuggcccccaugggaaauggcacagggcgccggagauga

SEQ ID NO: 29976 - RNA, 1617 nt, Artificial Sequence
  derived and/or modified sequence opt5 from VP1__Norovirus_and/or_Norovirus-like__KX514188
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaaccccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaauagcagauuucccauuaaccuugauaagcuguucaccggaccgucuuccgccaaugucgugcagccucagaacggccgguguacaaucgacggggaacuccugggaaccacgcaacugagccccguuaauaucugcacauuccgcggcgaugugacccauccuagagacucucagauuuacacaaugaaccucgccucccccaauuggaacaauuaugacccuaccgaggagauccccgcuccgcugggcaccccugauuuugucgggaaaauucagggaaugcuuacacagacgaccaagggcgaagggagcacacggggacaccgcgcgaccguguacgucggcuccgccaacuacgcucccaagcuggggagagugcaauucgagacagacaccacgaaugaucucgacgcccaucagaacacaaaauuuacccccguuggagugguccagggcggcgaaucuccuaaggggagcgagccgcaacagugggugcugcccuccuauagcggacgggauaccccuaauguucaccuugcccccgcuguggccccuacauuccccggcgaacagcugcucuuuuuccgcucuaccaucccuggguguggaggccaccccaacaugaaucuggacugccugcucccgcaggaguggguccaacauuuuuaccaggaggcggcuccugcccaguccgauguggcccugcuuagauucgugaaccccgacacaagccggguucuguuugaauguaaacuccacaagucuggguaugucacgguggcucauaccggccagcacgaucuggugauuccucccaacggauacuucagauuugacagcugggucaaucaauucuauacacuugccccgaugggcaacgggaccggacgcaaacgguga

SEQ ID NO: 29977 - RNA, 1617 nt, Artificial Sequence
  derived and/or modified sequence opt5 from VP1__Norovirus_and/or_Norovirus-like__KX354101
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucacagucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaaccccugcgccccugggcacgccggacuucguugggaaaauucagggagugcuuacccagacaacccggacagacggcagcacccgcgggcacaaggccacggucuacacaggauccgcugauuuugccccuaagcugggcagagugcaauucgagaccgacaccgaucgggacuuugaagccaaucagaacacaaaauucacccccguuggggugauccaggauggaggcacaacgcaucgcaaugagccccaacaguggguccucccuucuuacagcggcagaaacacccacaaugugcaccuggcuccggccguggcgcccacauuuccuggggaacagcuucuguucuuucgguccaccaugcccggauguagcggcuauccuaacauggaccucgauugccugcugccccaggaguggguucaauacuucuaucaggaggcugccccugcccagucugacgucgcucuccugagauuugugaaucccgauacagggcgcgugcuuuucgaauguaagcugcauaaauccggauacgucaccguggcccacacgggccagcaugaccucguuaucccgccuaacggguauuuucgguucgauagcugggugaaccaauucuacacccuggcucccaugggcaauggaacaggcagacgccgguga

SEQ ID NO: 29978 - RNA, 1617 nt, Artificial Sequence
  derived and/or modified sequence opt5 from VP1__Norovirus_and/or_Norovirus-like__KX354023
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggaaugcuuacgcagaccacacgggccgacggcagcacccgcgggcacaaggcuacaguguacaccggauccgccgauuuugccccuaagcugggcagaguccaauucgagacggacacagaucaugacuuugaagcuaaucagaacaccaaauucacccccguggggguuauccaggauggaucuacaacccaccggaaugagccccaacagugggugcucccuagcuacuccggccgcaacacacacaauguccaucuggccccgcccguggcgccuacguuucccggcgaacagcuucuguucuuuagaagcaccaugccuggguguucuggauaucccaacauggaccucgauugccugcugccucaggagugggugcaauacuucuaucaggaggcugcccccgcccaguccgacguugcucuccugcgguuugucaauccggauacaggcagagugcuuuucgaauguaagcugcacaaaagcggguacgugaccgucgcccauacaggacagcacgaccucgugauuccucccaacggcuauuuucgcuucgauucuuggguuaaccaauucuacacccuggcuccuauggggaauggcacgggacggagacgcuga

SEQ ID NO: 29979 - RNA, 1617 nt, Artificial Sequence
  derived and/or modified sequence opt5 from VP1__Norovirus_and/or_Norovirus-like__KX353979
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaugaucgucgacgugagacaacucgagccugugcugauuccccugccugauguccggaacaauuuuuaucacuacaaccagagcaaugaccccaccaucaagcucauugcuaugcuguauacaccccuucgcgccaacaacgcuggcgaugacguuuucaccguguccugcagagugcugacacggccuagcccggauuuugacuucaucuuucucgugcccccuaccgucgaaucucgcacgaaacccuucuccguuccugugcugaccgucgaggaaaugacaaauagcagauuucccauuccgcuugagaagcuguucaccgggccuucuuccgccuucgugguucagccccagaacggacgguguacaaccgauggcgugcuccuggggacgacacaacugagcccugucaauaucugcaccuuucgcggagacgugacacauauuucuggcuccagaaacuacaccaugaaucucgccagccagaacuggaacuccuaugaucccaccgaggaaaucccugcuccccugggcacaccggacuucgucgggaaaauccagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauucaggacggaagcacaacgccccggaacgaaccucaacaguggguucucccgucuuacuccggccgcaauauccauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucauuccucccaacggcuauuuucgcuucgacucuugggugaaucaauucuacacgcuggcuccuauggggaacggcaccggacggagacgcuga

SEQ ID NO: 29980 - RNA, 1617 nt, Artificial Sequence
  derived and/or modified sequence opt5 from VP1__Norovirus_and/or_Norovirus-like__AB972491
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugauccauauuaccggcucuagaaacuacacaaugaaucucgcuucccagaacuggagcaauuaugaucccaccgaggaaaucccugcgccccugggcaccccggacuucguugggaaaauccagggagugcuuacacagacgacccggacagacggcuccacccgcgggcacaaggccacagucuacaccggaucugcugauuuugccccuaagcugggcagagugcaauucgagacggacacagaucaugacuuugaagccaaccagaauaccaaauucacccccguuggggugauucaggauggaagcacaacccaccggaacgagccccaacaguggguccucccuuccuacagcggccgcaauacaccgaacgugcaccuggcucccgccguggcgccuacguuucccggcgaacagcuucuguucuuuagaucuaccaugccuggguguuccggauaucccaauauggaccucgauugccugcugccucaggaguggguucaauacuucuaucaggaggcugcccccgcccagagcgacgucgcucuccugcgguuugugaacccggauacaggcagagugcuuuucgaauguaagcugcauaaaucuggguacgucaccguggcccacacaggacagcaugaccucguuaucccucccaauggcuauuuucgcuucgauagcugggugaaccaauucuacacccuggcuccuauggggaacggcacgggacggagacgcuga

SEQ ID NO: 29981 - RNA, 1617 nt, Artificial Sequence
  derived and/or modified sequence opt5 from VP1__Norovirus_and/or_Norovirus-like__AB972469
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacacuccgcggagacgugacccauaucacaggcucuagaaacuacaccaugaaucuggcuucccagaacuggagcaauuaugaucccaccgaggaaauuccugcgccccuuggcacaccggacuuuguugggaaaauccagggagugcugacgcagaccacacggaccgacggcuccacacgcgggcacaaggccaccgucuacacgggaucugcugauuucgccccuaagcucggcagagugcaauuugagacagacaccgaucgggacuucgaagccaaccagaauaccaaauuuacacccguuggggugauccaggauggaagcaccacacaucgcaacgagccccaacaguggguccugccuuccuacagcggcagaaauacgccgaacgugcaccuugcucccgccguggcgccuaccuuccccggcgaacagcugcucuuuuuccggucuacaaugccuggguguuccggauaucccaauauggaccuggauugccugcucccucaggaguggguucaauacuuuuaucaggaggcugcccccgcccagagcgacgucgcucugcuuagauucgugaacccggauaccggccgcgugcuguuugaauguaagcuccacaaaucuggguacgucacaguggcccauaccggacagcacgaccugguuauuccucccaauggcuauuuccgguuugauagcugggugaaccaauucuacacgcuugcuccuauggggaacggcaccggaagacgccgguga

SEQ ID NO: 29982 - RNA, 1617 nt, Artificial Sequence
  derived and/or modified sequence opt5 from VP1__Norovirus_and/or_Norovirus-like__LC101819
augaagauggccagcaacgacgauaaucccuccgacggcucugcugccaaccuggugccugaggucaauaacgaaguuauggcgcucgagccgguggugggggcugccaucgccgcucccgucgccggacagcaaaaugugauugauccuuggaucagaaacaauuucguucaggcucccggcggggaauuuaccgugagcccucggaacgcccccggagagauucugugguccgcgccucuuggcccggaccugaaucccuaccucucucaccuggcccgcauguauaacggguacgcuggaggcuucgaaguccaggugauccuugccggcaaugcuuuuacagccgggaaaguuauuuucgcggccgugccucccaacuuuccuacggagggacugagccccucccaggucaccauguucccgcauaucgugguggaugucagacaacucgagccuguucugaucccccugccugacgugcggaauaacuuuuaucacuacaaucagucuaacgaucccacaauuaagcucaucgcuaugcuguauacaccccuucgcgccaacaaugcuggcgacgauguguucaccgucagcugcagagugcugacccggccuuccccggacuuugauuucauuuuucucguucccccuacaguggaaagccgcaccaaacccuucucugucccugugcugacgguugaggaaaugaccaacuccagauuucccaucccgcuugagaagcuguucacagggccuagcucugccuucgugguccagccccagaauggacgguguaccacagacggcgugcuccuggggaccacgcaacuguccccugucaacauuugcacauuucgcggagaugugacccauaucacaggcagcagaaauuacaccaugaaccucgccucucagaauuggaacaauuaugaccccaccgaggaaauuccugcuccccugggcacaccggacuucguugggaaaauccagggagugcuuacgcagaccacacggaccgauggcuccacacgcgggcacaaggcgaccgucuacacgggaagcgccgacuuugcuccuaagcugggcagagugcaauucgagacagauaccgaccaugauuuugaagccaaccagaauaccaaauucacacccguuggggugauccaggacggaggcaccacacaccggaacgagccccaacaguggguccucccuuccuacucuggccgcgauacgcacaaugugcaucuggccccggcuguggcccccaccuuuccuggggaacagcuucuguucuuuagaagcacaaugcccggauguuccggcuauccuaacauggaccucgauugccugcugccccaggaguggguucaauacuucuaucaggaggcggcuccugcccagagcgacgucgcccuccugcgguuugugaaucccgauaccgggagagugcuuuucgaauguaagcugcacaaaucuggauacgucacaguggcucauaccggccagcacgaccucguuauuccgccuaacggguauuuucgcuucgacuccugggugaacaaguucuacacgcuggcccccaugggcaauggaaccggccggagacgcuga

SEQ ID NO: 29983 - RNA, 1617 nt, Artificial Sequence
  derived and/or modified sequence opt5 from VP1__Norovirus_and/or_Norovirus-like__KT202795
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaggcaccacacaucgcaacgagccccaacaguggguccucccuagcuacuccggcagaaauauuccgaacgugcaccuggcucccgccguggcgccuacguuucccggggaacagcuucuguucuuucggagcaccaugccuggauguucuggcuaucccaauauggaccucgauugccugcugccucaggaguggguucaauacuucuaucaggaggcugcccccgcccaguccgacgucgcucuccugagauuugugaacccggauacagggcgcgugcuuuucgaauguaagcugcacaaaagcggauacgucaccguggcccauacaggccagcacgaccucguuaucccucccaauggguauuuucgguucgauucuugggugaaccaauucuacacccuggcuccuaugggcaacggaacgggcagacgccgguga

SEQ ID NO: 29984 - RNA, 1617 nt, Artificial Sequence
  derived and/or modified sequence opt5 from VP1__Norovirus_and/or_Norovirus-like__AB933742
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaaagcggguacgugacaguggcccauaccggacagcacgaucucgucauucccccuaacggcuauuuucgcuucgacuccuggaucaaucaauucuacacgcuggcucccauggggaacggcaccggacggagacgcuga

SEQ ID NO: 29985 - RNA, 1617 nt, Artificial Sequence
  derived and/or modified sequence opt5 from VP1__Norovirus_and/or_Norovirus-like__AB933722
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcgccaaaccuuucaccguucccauccugacgguggaagagaugaccaauagcagauuuccuauuccccuugagaagcuguucacagggccgucuuccgcuuucgucgugcagccucagaacggacgguguaccacagacggcguucuccuggggaccacgcaacugagccccgugaauaucugcacauuucgcggagaugucacccauaucgcgggcucuagaaacuacacaaugaaucucgccuccccuaacuggaauaacuaugaccccaccgaagagauuccugcuccccugggcaccccggauuucguggggaaaauccagggaaugcuuacacagacgaccaagggcgacgggagcacacggggacacaaggccaccgucuacacaggcuccgccccuuuuacccccaaacuggggucugugcaguucagcacggacacagaaaaugauuuugagacccaucaaaacaccaaguucacacccguuggagugauucaggacggcuccaccacacaccgcaaugaaccucagcaauggguccucccgagcuacucuggcagaaacgugcccaauguucaccuggcuccugccguggcgcccacguuuccuggggagcagcuucuguucuuucgguccaccaugcccggauguagcggcuauccuaacauggaucucgacugccugcugccccaggaguggguccagcauuucuaccaagaagcugccccggcccagucugauguggcucuccugcgcuuugugaauccugacacagggagaguucuuuucgaguguaaacugcacaagagcggauaugucaccguggcccauacaggccagcacgaucucgugauucccccuaacggguacuuucgguucgacuccugggucaaccaguucuauacccuggcucccaugggcaauggaacgggcagacgccgguga

SEQ ID NO: 29986 - RNA, 1617 nt, Artificial Sequence
  derived and/or modified sequence opt5 from VP1__Norovirus_and/or_Norovirus-like__KJ678138
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacaucggaagcgcugauuuugccccuaagcugggcagagugcaauucgagacggacacagaucaugacuuugaagccaaucagaacaccaaauucacccccguuggggugauucaggauggauccacaacccaccggaaugagccccaacaguggguccucccuagcuacucuggccgcaacacaccgaaugugcaccuggcucccgccguggcgccuacguuucccggcgaacagcuucuguucuuuagauccaccaugccuggguguagcggauaucccaacauggaccucgauugccugcugccucaggaguggguucaauacuucuaucaggaggcugcccccgcccagucugacgucgcucuccugcgguuugugaauccggauacaggcagagugcuuuucgaauguaagcugcauaaaagcggguacgucaccguggcccacacaggacagcaugaccucguuaucccucccaacggcuauuuucgcuucgauuccugggugaaucaauucuacacccuggcuccuauggggaacggcacgggacggagacgcuga

SEQ ID NO: 29987 - RNA, 1617 nt, Artificial Sequence
  derived and/or modified sequence opt5 from VP1__Norovirus_and/or_Norovirus-like__KP244317
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcucgccuguauacaccccuuagagccaauaacgcuggcgaugacguuuucaccgugagcugccgggugcugacacgcccuucuccggauuuugacuucauuuuucucgugcccccuaccgucgaauccagaacgaaacccuucagcguuccugugcugaccgucgaggaaaugacaaacucucgguuucccaucccgcuugagaagcuguucaccgggccuuccagcgccuucgugguucagccccagaauggacgcuguacaaccgauggcgugcuccuggggacgacacaacugucuccugucaacauuugcaccuuuagaggagacgugacacauaucuccggcagccggaauuacaccaugaaccucgccucccagaauuggaacucuuaugaucccaccgaggaaaucccugcuccccugggcacaccggacuucgucgggaaaauucagggagugcuuacgcagaccacaaagaccaauggcagcacacgcgggcacaaggcgaccguuuacacgggauccgccgacuuuagcccuaaacugggcagagugcaauucgcuacagauaccgacaacgauuuugagaccaaucagaacacaaaguucacccccgucggggugauccaggacggaucuacaacgccccggaaugaaccucaacaguggguucucccguccuacagcggccgcaacacccauaaugugcaccuggcccccgccgucgcuccuacauuucccggcgagcagcuucuguucuuuagaucuaccaugccuggguguagcggauaucccaacauggaucucgacugccugcugccucaggaaugggugcaauacuucuaucaggaggccgcgcccgcucaguccgauguggcccuccugcgguuuguuaauccggacacaggcagaguccuuuucgaguguaaacugcacaagucuggguacgugaccguggcccauacgggacagcacgaucucgucauuccucccaacggcuauuuucgcuucgacagcugggugaaccaauuccauacccuggcuccuauggggaauggcacaggacggagacgcuga

SEQ ID NO: 29988 - RNA, 1617 nt, Artificial Sequence
  derived and/or modified sequence opt5 from VP1__Norovirus_and/or_Norovirus-like__KP698925
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaaaccaaccagaauacaaaauucacccccguuggggugauccaggauggaagcacaacgcaccggaacgagccccaacaguggguccucccuuccuacagcggccgcaauaccccgaacgugcaccuggcccccgcuguggccccuacauuucccggcgaacagcuucuguucuuuagaucuaccaugccuggguguuccggauaucccaauauggaccucgauugccugcugccucaggaguggguucaauaccucuaucaggaggcggcucccgcccagagcgacgucgcccugcuucgguucgugaacccggauacaggcagagugcuguuugaauguaagcuccauaaaucuggguacgucaccguggcucacacgggacagcaugaccugguuauuccucccaauggcuauuuccgcuuugauagcugggugaaccaauucuacacccuugccccuauggggaacggcacaggacggagacgcuga

SEQ ID NO: 29989 - RNA, 1617 nt, Artificial Sequence
  derived and/or modified sequence opt5 from VP1__Norovirus_and/or_Norovirus-like__LC005727
augaagauggccagcuccgacgcuaaucccccugauggcucugccgcgaaccuggugccggaggucaacaaugaaguuauggcucucgagcccguggugggggccgccaucgcugccccugucgcuggacagcaaaacgugauugaccccuggaucagaaauaacuucguucaggccccuggcggggaauuuaccgugagcccccggaaugcgccuggagagauucugugguccgccccgcuuggccccgaucugaacccuuaccucucucaccuggcucgcauguauaauggguacgccggaggcuucgaaguccaggugauccuugcuggcaacgccuuuacagcggggaaaguuauuuucgccgcugugcccccuaauuuucccacggagggacugagcccgucccaggucaccauguucccucauaucgugguggacgucagacaacucgagcccguucugaucccucugcccgaugugcggaacaauuuuuaucacuacaaccagucuaaugaccccacaauuaagcucaucgccaugcuguauaccccucuucgcgcuaacaacgccggcgaugacguguucacagucagcugcagagugcugacccggccgucccccgauuuugacuucauuuuucucguuccucccacaguggaaagccgcaccaaaccuuucucuguccccgugcugacgguugaggaaaugaccaauuccagauuuccgaucccucuugagaagcuguucacagggcccagcucugccuucgugguccagccucagaacggacgguguaccacagauggcgugcuccuggggaccacgcaacugucccccgucaauauuugcacauuucgcggagacgugacccauaucacaggcagccacaacuacaccaugaaucucgcuucucagaacuggaauaacuaugauccuaccgaggaaauucccgcgccgcugggcacaccugacuucguugggaaaauccagggagugcuuacgcagaccacaagaaccgacggcuccacacgggggcauaaggccaccgucuacacgggaagcgcugauuuugcccccaagcugggccgcgugcaauucgagacagacaccaaucacgauuuugaagccaaccagaauaccaaauucacacccguuggggugauccaggacggaggcaccacacacagaaacgagccucaacaguggguccucccguccuacucuggccggaauacgcauaacgugcaccuggcucccgccguggcgccuaccuuucccggggaacagcuucuguucuuucgcagcacaaugccuggauguuccggcuaucccaauauggaucucgacugccugcugccucaggaguggguucaauacuucuaucaggaggcugcccccgcccagagcgaugucgcucuccugagauuugugaacccggacaccgggcgggugcuuuucgaauguaagcugcauaaaucuggauacgucacaguggcccacaccggccagcacgaucucguuauuccucccaacggguauuuuagauucgacuccugggugaaucaauucuacacgcuggcuccuaugggcaacggaaccggccgccggagauga

SEQ ID NO: 29990 - RNA, 1617 nt, Artificial Sequence
  derived and/or modified sequence opt5 from VP1__Norovirus_and/or_Norovirus-like__LC016603
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcaccuccacauacagaaugaaccucgccagccagaauuggaacaauuaugauccuacggaggaaauucccgcuccucugggcacccccgacuucguggggaaaauccagggaaugcuuacacagaccacaaagggcgacggguccacccggggacacaaggcgacggucucuacaggcagcguggauuuuaccccgaaacugggguccguucaauucgccaccgacacagauaacgacuuugagaccggacagaauacacgcuucacgccugugggcgucauucaggauggcagcggggcucauagaaacgaaccccaacagugggugcuccccgacuacucuggaaagaccguucacaaugugcaccuggccccugccgucgcuccgacauuucccggcgagcagcuucuguucuuucgguccaccaugccuggguguagcggauaccccaacauggaucucgacugccugcugccucaggaaugggugcaacauuucuaucaggaggccgcgcccgcucagucugauguggcccuccugcgcuuuguuaauccugacacaggcagaguccuuuucgaguguaaacugcacaagaccggguacgugacgguggcccauaccggccagcacgaucucgucauucccccgaacggauauuuucgguucgacagcugggugaaucaauucuacacacuggcuccuaugggcaacggggccggaagacgccgguga

SEQ ID NO: 29991 - RNA, 1617 nt, Artificial Sequence
  derived and/or modified sequence opt5 from VP1__Norovirus_and/or_Norovirus-like__LC016599
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuucuaccagaacauaccggaugaaccucgccucccagaauuggaacaauuaugaucccacggaggaaauuccugcuccccugggcaccccggacuucgugggcaaaauccaggggaugcuuacacagaccacaaagggagacggcagcacccgcgggcacaaggcgacggucuccacaggaucuguggauuuuaccccuaaacugggcagcguucaauucgccaccgacacagauaacgacuuugagaccgggcagaauacaagauucacgcccgugggagucauucaggauggcuccagcgcucaucggaacgaaccccaacagugggugcucccugacuacucuggccgcaccguucacaaugugcaccuggccccggccgucgcucccacauuuccuggggagcagcuucuguucuuuagauccaccaugcccggauguagcggcuacccuaacauggaucucgacugccugcugccccaggaaugggugcaacauuucuaucaggaggccgcgccugcucagucugauguggcccuccugcgguuuguuaaucccgacacagggagaguccuuuucgaguguaagcugcacaaaaccggauacgugacgguggcccauaccggccagcacgaucucgucaucccgccuaacggguauuuucgcuucgacagcugggugaaucaauucuacacacuggcucccaugggcaacggagccggccggagacgcuga

SEQ ID NO: 29992 - RNA, 1617 nt, Artificial Sequence
  derived and/or modified sequence opt5 from VP1__Norovirus_and/or_Norovirus-like__KP293587
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucaagccuguucugaucccccugccugaugugcggaacaauuuuuaucacuacaaccagagcaaugaccccacaauuaaacucaucgccaugcuguauacaccccuucgcgcuaacaacgccggcgaugacguguucaccgucuccugcagagugcugacccggccuagcccggauuuugacuucauuuuucucguucccccuacaguggagucucgcaccaagcccuucuccgucccugugcugacgguugaagagaugaccaauagcagauuucccaucccgcuugaaaaacuguucacagggccuucuuccgccuucgugguccagccccagaacggacgguguaccacagauggcgugcuccuggggaccacgcaacugagcccugucaauauuugcacauuucgcggagacgugacccauaucacaggcucucacuccuacaccaugaaccucgcuagccagaauugguccaacuaugaucccaccgaggagauuccugcgccccugggcacaccggacuucguugggaagauccagggagugcuuacgcagaccacaagaaccgacggcucuacacgggggcauaaggccaccgucuacacgggaagcgcugauuuugccccuaaacugggccgcgugcaauucgaaacagacaccaaucacgauuuugaggccaaccagaauaccaaguucacacccguuggggugauccaggacggauccaccacacacagaaacgaaccccaacaguggguccucccuagcuacucuggccggaauacgccgaacgugcaucuggcucccgccguggcgccuaccuuucccggcgagcagcuucuguucuuucgcuccacaaugccuggguguagcggauaucccaauauggaucucgacugccugcugccucaggaauggguucaauacuucuaucaggaggcugcccccgcccagucugaugucgcucuccugagauuugugaacccggacaccggccgggugcuuuucgaguguaaacugcacaagagcggguacgucacaguggcccauaccggacagcacgaucucguuauuccucccaauggcuauuuuagauucgacuccugggugaaccaauucuacacgcuggcuccuaugcgcaacgggaccggccggagacgcuga

SEQ ID NO: 29993 - RNA, 1617 nt, Artificial Sequence
  derived and/or modified sequence opt5 from VP1__Norovirus_and/or_Norovirus-like__KP176402
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaaccugguucaggcccccggcggggaguucaccguguccccucggaaugcgcccggagaaauucuuuggucugccccucugggcccggaacucaaccccuaccugagccaccuugcucgcauguauaauggguacgccggaggcuuugagguccaggugauccuggcuggcaacgccuucacagcggggaaaguuauuuuugccgcugugccucccaauuucccuacggagggacucucccccucucaggucaccauguuuccgcauaucgugguggaugucagacaacuggaaccuguucugaucccccucccugacgugcggaacaauuucuaucacuacaaccagagcaaugaucccacaauuaagcugaucgccaugcuuuauacaccccugcgcgcuaacaacgccggcgacgauguguuuaccgucuccugcagagugcucacccggccuagcccggacuucgauuuuauuuuccugguucccccuacaguggagucucgcaccaaacccuuuuccgucccugugcuuacgguugaagagaugaccaauagcagauuccccaucccgcuggagaagcucuuuacagggccuucuuccgccuucgugguccagccccagaacggacgguguaccacagacggcgugcugcuggggaccacgcaacucagcccugucaauauuugcacauuccgcggagaugugacccauaucacaggcucuagaaacuacaccaugaaucuggcuucccagaacuggagcaauuaugaccccaccgaagagauuccugcgccccuuggcacaccggauuuuguugggaaaauccagggagugcugacgcagaccacacggaccgacggcuccacacgcgggcacaaggccaccgucuacacgggaucugcugacuucgccccuaagcucggcagagugcaauuugaaacagauaccgaccgggauuucgaggccaaccagaauaccaaauuuacacccguuggggugauccaggacggaagcaccacacaucgcaacgaaccccaacaguggguccugccuuccuacagcggcagaaauacgccgaacgugcaccuugcucccgccguggcgccuaccuuccccggcgagcagcugcucuuuuuccggucuacaaugccuggguguuccggauaucccaauauggaucuggacugccugcucccucaggaguggguucaauacuuuuaucaggaagcugcccccgcccagagcgaugucgcucugcuuagauucgugaacccggacaccggccgcgugcuguuugaguguaagcuccacaaaucuggguacgucacaguggcccauaccggacagcacgaucugguuauuccucccaauggcuauuuccgguuugacagcugggugaaccaauucuacacgcuugcuccuauggggaacggcaccggaagacgccgguga

SEQ ID NO: 29994 - RNA, 1617 nt, Artificial Sequence
  derived and/or modified sequence opt5 from VP1__Norovirus_and/or_Norovirus-like__KJ196287
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaaugggcaugcuggaggcuucgaaguccaggugauccuugccggcaacgcuuuuacggccgggaaaauuaucuucgcggccguuccucccaauuuuccuaccgagggacugucccccucucaggugacaauguucccgcacaucauugucgacgugagacaacucgagccugugcugaucccccugccugauguccggaacaauuuuuaccauuauaaccagagcaaugacuccaccauuaagcucaucgcuaugcuguacacaccccuucgcgccaacaacgcuggcgaagauguuuucaccgugagcugcagagugcugacacggcccucuccugacuuugauuucauuuuucucgucccgcccaccguggagucccgcacgaaaccuuucaccguucccauccugacaguggaagagaugaccaauagcagauuuccuauuccccuugagaagcuguucacagggccgucuuccgccuucgucgugcagccucagaacggacgguguaccacggacggcguucuccuggggacaacccaacugagccccgugaauaucugcacauuucgcggagaugucacccacaucgccggcucuagaaacuauaccaugaaucucgcuucccugaacuggaauaacuacgacccuacagaagagauucccgcgccucuuggcacgcccgauuucguggggaaaauccagggaguccugacccagacaaccaagggcgacgggagcacacggggacauaaggccaccguguauacgggcuccgcuccguuuacaccuaaacucgggucuguucaguucagcaccgacaccgaaaaugauuuugagacacaccaaaacaccaaguucacacccgugggagucauucaggacggcggcacgacccaccgcaaugaaccccagcaaugggugcugccuuccuacagcgggagaaacguucauaaugugcaccuugccccggccgucgcucccacauuuccuggagagcagcuccuguucuuucggucuaccaugcccggcuguuccggguacccuaacauggaucuggacugccugcucccccaggagugggugcagcauuucuaucaagaagccgcgccugcucagagcgauguggcccugcuucgcuuuguuaaucccgacacaggaagaguccuguucgaguguaaacuccacaagucuggcuacgugaccguggcccacacggggcagcaugaucuggucaucccgccuaacggcuauuuucgguucgacagcugggugaaccaguucuacacccuugcucccaugggaaauggcacagggagacgccgguga

SEQ ID NO: 29995 - RNA, 1617 nt, Artificial Sequence
  derived and/or modified sequence opt5 from VP1__Norovirus_and/or_Norovirus-like__KM198480
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagagauguucacaacgugcaucuugccccggcugucgcccccacauuuccuggcgagcagcuccuguucuuucgguccaccaugcccggguguagcggauauccuaauauggaccuggauugccugcucccccaggagugggugcagcacuucuaccaagaagcggcuccugcccagucugacguggcccugcuucgcuuuguuaaccccgauacaggcagaguccuguucgaguguaaacucuauaaguccggguacgugaccguggcucauacgggccagcacgaccuggucaucccgccuaauggauauuuucgguucgauagcugggugaaccaguucuacacccuugcccccaugggcaacgggacaggaagacgccgguga

SEQ ID NO: 29996 - RNA, 1617 nt, Artificial Sequence
  derived and/or modified sequence opt5 from VP1__Norovirus_and/or_Norovirus-like__KJ716357
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaaugggcaugccggaggcuucgaaguccaggugauccuugcuggcaacgccuuuacagcggggaaaguuauuuucgccgcugugccucccaauuuuccuacggagggacugucccccucucaggucaccauguucccgcacaucgugguggacgucagacaacucgagccuguucugaucccccugccugaugugcggaacaauuuuuaccauuauaaccagagcaaugaccccacaauuaagcucaucgccaugcuguacacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccacaucacaggcucuagaaacuauaccaugaaucucgcuucccagaacuggaauaacuacgaucccaccgaggaaauuccugcgccccugggcacaccggacuucguugggaaaauccagggagugcuuacgcagaccacacggaccgacggcagcacacgcgggcauaaggccaccgucuauacgggauccgcugauuuugccccuaagcugggcagagugcaauucgagacagacaccgaucacgacuuugaagccaaucagaacaccaaauucacacccguuggggugauccaggauggaggcaccacacaccggaaugagccccaacaguggguccucccuucuuacagcggccgcaacacgcauaaugugcaccuggcuccggccguggcgcccaccuuuccuggggaacagcuucuguucuuuagauccacaaugcccggauguagcggcuacccuaacauggaccucgauugccugcugccccaggaguggguucaauauuucuaccaggaggcugccccugcccagucugacgucgcucuccugcgguuugugaaucccgauaccgggagagugcuuuucgaauguaagcugcauaaauccggauaugucacaguggcccacaccggccagcacgaccucguuauuccgccuaacggguacuuucgcuucgauagcugggugaaccaauucuauacgcuggcucccaugggcaauggaaccggccggagacgcuga

SEQ ID NO: 29997 - RNA, 1617 nt, Artificial Sequence
  derived and/or modified sequence opt5 from VP1__Norovirus_and/or_Norovirus-like__KJ716354
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacaucggauccgcugauuuugccccuaagcugggcagagugcaauucgagacggacacagaucaugacuuugaagccaaucagaacaccaaauucacccccguuggggugauucaggauggaggcacaacccaccggaaugagccccaacaguggguccucccuucuuacagcggccgcaacacacacaaugugcaucuggcuccggccguggcgcccacguuuccuggggaacagcuucuguucuuuagauccaccaugcccggauguagcggcuauccuaacauggaccucgauugccugcugccccaggaguggguucaauacuucuaucaggaggcugccccugcccagucugacgucgcucuccugcgguuugugaaucccgauacagggagagugcuuuucgaauguaagcugcacaaauccggauacgucaccguggcccauacaggccagcacgaccucguuaucccgccuaacggguauuuucgcuucgauagcugggugaaccaauucuacacccuggcucccaugggcaauggaacgggccggagacgcuga

SEQ ID NO: 29998 - RNA, 1617 nt, Artificial Sequence
  derived and/or modified sequence opt5 from VP1__Norovirus_and/or_Norovirus-like__KJ685403
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucacaaccgacaccgauaaugacuuugucacaaaucagaacaccaaauucacacccguggggguuauccaggauggaagcacgacaccccggaaugagccucaacagugggugcucccgucuuacuccggccgcaacacccauaauguccaccuggcucccgccguggccccuaccuuucccggcgaacagcuucuguucuuuagaagcacaaugccuggguguucuggauaucccaacauggaccucgauugccugcugccucaggagugggugcaauacuucuaucaggaagcugcccccgcgcagagcgacguugcucuccugcgguuugucaauccggauaccggcagagugcuuuucgaguguaagcugcacaaauccggguacgugacggucgcccauaccggacagcacgaccucgugauuccucccaacggcuauuuucgcuucgauucuuggguuaaccaauucuacacacuggccccuauggggaauggcaccggacggagacgcuga

SEQ ID NO: 29999 - RNA, 1617 nt, Artificial Sequence
  derived and/or modified sequence opt5 from VP1__Norovirus_and/or_Norovirus-like__KF060108
augaagauggccagcuccgacgcuaaccccucugauggcagcuccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuaccgugucuccucggaaugcccccggagagauucuguggagcgcgccucuuggcccggaucugaaccccuaccucucccaccuggcccgcauguauaauggguacgcuggaggcuucgaaguccaggugauccuugccggcaacgcuuuuacagccgggaaaauuaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccaguccaaugaccccacaauuaagcucaucgcuaugcuguauacaccccuucgcgccaacaacgcuggcgaugacguuuucaccgugagcugcagagugcugacccggccuucuccggauuuugacuucauuuuucucgugcccccuacagucgaaucccgcaccaaacccuucagcguuccugugcugacggucgaggaaaugaccaauucuagauuucccaucccgcuugagaagcuguucacagggccuuccagcgccuucgugguucagccccagaacggacgguguaccacagauggcgugcuccuggggaccacgcaacugucuccugucaauauuugcacauuucgcggagacgugacccauaucuccggcagcagaaacuacacaaugaaucucgccucccagaacuggaacucuuaugaucccaccgaggaaaucccugcuccccugggcaccccggacuucgucgggaaaauucagggagugcuuacacagacgacccggacagacggcagcacccgcgggcacaaggcgacaguuuacaccggauccgccgauuuuagcccuaagcugggcagagugcaauucgcuacggacacagauaaugacuuugucaccaaucagaacaccaaauucacacccguggggguuauccaggauggaucuaccacaccccggaaugagccucaacagugggugcucccguccuacagcggccgcaacacgcauaauguccaccuggcccccgccguggcuccuaccuuucccggcgaacagcuucuguucuuuagaucuacaaugccuggguguagcggauaucccaacauggaccucgauugccugcugccucaggagugggugcaauacuucuaucaggaagccgcgcccgcucaguccgacguugcccuccugcgguuugucaauccggauaccggcagagugcuuuucgaguguaagcugcacaaaucuggguacgugacagucgcccauaccggacagcacgaccucgugauuccucccaacggcuauuuucgcuucgauagcuggguuaaccaauucuacacgcuggcuccuauggggaauggcaccggacggaagagauga

SEQ ID NO: 30000 - RNA, 1617 nt, Artificial Sequence
  derived and/or modified sequence opt5 from VP1__Norovirus_and/or_Norovirus-like__KF060099
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccgacggcuccacacgcgggcacaaggcgaccguuuacacgggaucugccgauuuuagccccaagcugggcagagugcaauucgcuacagacaccgauaacgacuuugucaccaaucagaacacaaaauucacccccguggggguuauccaggauggauccacaacgccucggaaugagccgcaacagugggugcuccccagcuacucuggccgcaacacccauaauguccaccuggccccugccguggcucccacauuuccuggcgaacagcuucuguucuuuagauccaccaugcccggguguagcggauauccuaacauggaccucgauugccugcugccccaggagugggugcaauacuucuaucaggaagccgcgccggcucagucugacguugcccuccugcgguuugucaauccugauacaggcagagugcuuuucgaguguaagcugcacaaaagcggguacgugaccgucgcccauacgggacagcacgaccucgugauucccccuaacggcuauuuucgcuucgauuccuggguuaaccaauucuacacccuggcucccauggggaauggcacaggacggagacgcuga

SEQ ID NO: 30001 - RNA, 1617 nt, Artificial Sequence
  derived and/or modified sequence opt5 from VP1__Norovirus_and/or_Norovirus-like__KF060004
augaagauggccagcuccgacgcuaaccccucugauggcagcguggccaaucuggucccugagguuaacaaugaagugauggcgcucgagccgguggucggggcugccaucgccgcucccguggccggacagcaaaacguuauugacccuuggaucagaaauaacuucgugcaggcucccggcggggaauuuaccgucuccccucggaaugcccccggagagauucuguggucugcgccucuuggcccggaucugaaccccuaccucagccaccuggcccgcauguauaauggguacgcuggaggcuucgaagugcagguuauccuugccggcaacgcuuuuacagccgggaaagugauuuucgcggccgucccucccaauuuuccuacggagggacugucccccucucaggugaccauguucccgcauaucguggucgacguuagacaacucgagccugugcugaucccccugccugaugugcggaacaauuuuuaucacuacaaccagagcaaugaccccacaauuaagcucaucgcuaugcuguauacaccccuucgcgccaacaacgcuggcgaugacgucuucaccguguccugcagaguucugacccggccuagcccggauuuugacuucauuuuucucgugcccccuacagucgaaucucgcaccaaacccuucuccgugccuguucugacgguggaggaaaugaccaauagcagauuucccaucccgcuugagaagcuguucacagggccuucuuccgccuucgucgugcagccccagaacggacgguguaccacagauggcguccuccuggggaccacgcaacugagcccugugaauauuugcacauuucgcggagacguuacccauaucacaggcucuagaaacuacaccaugaaucucgccucccagaacuggaauaacuaugaucccaccgaggaaauuccugcuccccugggcacaccggacuucguggggaaaauccagggaguccuuacgcagaccacacggaccgacggcagcacacgcgggcacaaggcgaccguguacacgggauccgccgauuuugcuccuaagcugggcagaguucaauucgagacagacaccgaucaugacuuugaagccaaucagaacaccaaauucacacccgugggggucauccaggauggaggcaccacacaccggaaugagccccaacagugggugcucccuucuuacagcggccgcaacacgcacaaugugcaucuggccccggcuguugcccccaccuuuccuggggaacagcuucuguucuuuagauccacaaugcccggauguagcggcuauccuaacauggaccucgauugccugcugccccaggaguggguccaauacuucuaucaggaggcggcuccugcccagucugacguggcccuccugcgguuugugaaucccgauaccgggagaguccuuuucgaauguaagcugcacaaauccggauacgugacaguugcucauaccggccagcacgaccucgugauuccgccuaacggguauuuucgcuucgauagcugggucaaccaauucuacacgcuggcccccaugggcaauggaaccggccggagacgcuga

SEQ ID NO: 30002 - RNA, 1617 nt, Artificial Sequence
  derived and/or modified sequence opt5 from VP1__Norovirus_and/or_Norovirus-like__KF060006
augaagauggccagcuccgacgcuaaccccucugauggcagcaccgccucccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugucuccucggaacgcccccggagagauucuguggagcgcgccucuuggcccggaucugaaucccuaccucucccaccuggcccgcauguauaacucuuacgcugggggauucgaaguccaggugauccuugccggcaaugcuuuuacggccggcaaaauuaucuucgcggccguuccucccaacuuuccuaccgaggggcugagccccucccaggugacaauguucccgcauaucauugucgacgugagacaacucgagccugugcugaucccccugccugauguccggaauaacuuuuaucacuacaaucagagcaacgaccccaccauuaagcucaucgcuaugcuguauacaccccuucgcgccaauaacgcuggagaugacguuuucaccgugucuugcagagugcugacacggccuuccccggauuuugacuucauuuuucucgugcccccuaccgucgaaagccgcacgaaacccuucucuguuccugugcugaccgucgaggaaaugacaaacuccagauuucccaucccgcuugagaagcuguucaccggcccuagcucugccuucgugguucagccccagaaugggcgguguacaaccgauggagugcuccugggcacgacacaacuguccccugucaacauuugcaccuuucgcggggacgugacacauaucagcggaucccacaauuacaccaugaaccucgccucucagaauuggaacagcuaugaucccaccgaggaaaucccugcuccccugggcacaccggacuucgucggcaaaauucagggggugcuuacgcagaccacaagaaucaauggauccacccggggccauaaggcgacaguuuacaccgggagcgccgacuuuucuccuaagcugggacgcgugcaauucgcuacggauacagacaacgauuuugagaccaaucagaacaccaaauucacacccgucggcgugauucaggacggguccaccacacccagaaaugaaccucaacaguggguucucccgagcuacucuggacggaacacgcacaaugugcaccuggcccccgccgucgcuccuaccuuucccggcgagcagcuucuguucuuucgcagcacaaugccuggcuguuccggguaucccaacauggaucucgacugccugcugccucaggaaugggugcaauacuucuaucaggaggccgcgcccgcucagucugauguggcccuccugagauuuguuaauccggacaccggacggguccuuuucgaguguaagcugcauaaaagcggcuacgugacaguggcccacaccgggcagcaugaucucgucaucccucccaacggauauuuuagauucgacuccugggugaaccaauucuacacgcuggcuccuaugggcaaugggaccggccgccggagauga

SEQ ID NO: 30003 - RNA, 1617 nt, Artificial Sequence
  derived and/or modified sequence opt5 from VP1__Norovirus_and/or_Norovirus-like__KC517371
augaagauggccagcaacgacgcuaaucccuccgauggcucugccgcgaaccuggugccugaggucgacaaugaaguuauggcucucgagccgguggugggggccgccaucgcugcccccgucgcuggacagcaaaacgugauugauccuuggaucagaaauaacuucguucaggcccccggcggggaauuuaccgugagcccucggaaugcgcccggagagauucugugguccgccccucuuggcccggaccugaaccccuaccucucucaccuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcauaucauugucgaugugagacaacucgagccugugcugaucccccugccugacguccggaacaauuuuuaucacuacaaccagucuaaugauagcacaauuaagcucaucgccaugcuguauacaccccuucgcgcuaacaacgccggcgaagacguuuucaccguguccugcagagugcugacccggcccagcccugauuuugacuucauuuuucucgccccgcccacagucgagucucgcaccaaaccuuucacggugcccauccugaccguugaagagaugacaaauuccagauuuccuauuccccuugagaagcuguucaccgggccgagcucugcuuucgugguccagccucagaacggacgguguacaaccgauggcgugcuccuggggacgacacaacugucccccguuaauaucugcaccuuucgcggagacgugacacauaucgcgggcagcagaaacuacaccaugaaucucgccucucugaacuggaauaacuaugauccuaccgaagagauucccgcuccucuuggcacacccgacuucgucgggaaaauccagggaaugcugacgcagaccacaaagggcgacggguccacccggggacacaaggccacaguguacaccggcagcgccccguuuacgccuaaacucggguccguccaguucgaaacagauaccgagaaugacuuugaaacccaucaaaacacaaaguucacccccgugggaguuauucaggauggcggcacaacgcaccgcaaugagccccagcaaugggugcugccuucuuacagcgggagaaacgucccgaaugugcaccuugcucccgccguugcgccuaccuuucccggagagcagcuccuguucuuucgguccacaaugccuggcuguagcggguaucccaacauggaccuggauugccugcucccucaggaaugggugcagcauuucuaccaagaggcugcccccgcccagucugacgucgcucugcuucgcuuugugaauccggauaccggaagagugcuguucgaauguaaacuccacaaguccggcuauguuacagucgcccauaccgggcagcacgaccuggugaucccucccaacggcuacuuucgguucgauagcugggugaaccaguucuauacgcuugcuccuaugggaaauggcaccgggagacgccgguga

SEQ ID NO: 30004 - RNA, 1617 nt, Artificial Sequence
  derived and/or modified sequence opt5 from VP1__Norovirus_and/or_Norovirus-like__JX459657
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucgucguggacgugagacaacucgagccuguccugauuccccugccugauguucggaauaacuuuuaucauuacaaucagagcaacgaccccaccaucaagcucauugcuaugcuguauacaccccuucgcgccaauaacgcuggcgaugacguguucaccguguccugcagaguccugacacggccuagcccggauuuugacuucaucuuucucgugcccccuaccguugaaucucgcacgaaacccuucuccgugccuguccugaccguggaggaaaugacaaacagcagauuucccauuccgcuugagaagcuguucaccgggccuucuuccgccuucguugugcagccccagaauggacgguguacaaccgauggcguccuccuggggacgacacaacugagcccugugaacaucugcaccuuucgcggagacgucacacacauuucuggcuccagaaauuacaccaugaaccucgccagccagaauuggaacuccuaugaucccaccgaggaaaucccugcuccccugggcacaccggacuucguggggaaaauccagggaguucuuacgcagaccacacggaccgacggcucuacacgcgggcauaaggcgaccguguacacgggaagcgccgauuuuuccccuaagcugggcagaguccaauucgcuacagacaccgauaaugacuuugugaccaaccagaauacaaaauucacccccguuggggugauucaggauggaagcacaacgccccggaacgagccucaacaguggguccucccgucuuacuccggccgcaauacccacaacgugcaccuggcccccgccguggcuccuacauuucccggcgaacagcuucuguucuuuagaagcaccaugccuggguguucuggauaucccaauauggaccucgauugccugcugccucaggaguggguucaauacuucuaucaggaagccgcgcccgcucagagcgacgucgcccuccugcgguuugugaacccggauacaggcagagugcuuuucgaguguaagcugcauaaauccggguacgucaccguggcccacacgggacagcaugaccucguuaucccucccaauggcuauuuucgcuucgauucuugggugaaccaauucuacacccuggcuccuauggggaacggcacaggacggagacgcuga

SEQ ID NO: 30005 - RNA, 1617 nt, Artificial Sequence
  derived and/or modified sequence opt5 from VP1__Norovirus_and/or_Norovirus-like__JX459656
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucauugucgacgugagacaacucgagccugugcugaucccccugccugauguccggaauaacuuuuaucauuacaaucagagcaacgaccccaccauuaagcucaucgcuaugcuguauacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacacauccccggcucuagaaauuacaccaugaaccucgccucccagaauuggaacagcuaugauccuaccgaggaaauccccgcuccgcugggcacaccugacuucgucgggaaaauucagggagugcuuacgcagaccacacggaccaauggcuccacacgcgggcauaaggcgaccguuuacacgggaucugccgacuuuagccccaagcugggcagagugcaauucgcuacagauaccgacaacgauuuugagaccaaucagaacacaaaauucacccccgucggggugauccaggacggauccacaacgccucggaaugaaccgcaacaguggguucuccccagcuacucuggccgcaacauucacaaugugcaccuggccccugccgucgcucccaccuuuccuggcgagcagcuucuguucuuuagauccacaaugcccggguguagcggauauccuaacauggaucucgacugccugcugccccaggaaugggugcaauacuucuaucaggaggccgcgccggcucagucugauguggcccuccugcgguuuguuaauccugacaccggcagaguccuuuucgaguguaagcugcauaaaagcggguacgugacaguggcccacaccggacagcaugaucucgucauucccccuaacggcuauuuucgcuucgacuccugggugaaccaauucuacacgcuggcucccauggggaauggcaccggacggagacgcuga

SEQ ID NO: 30006 - RNA, 1617 nt, Artificial Sequence
  derived and/or modified sequence opt5 from VP1__Norovirus_and/or_Norovirus-like__JX445152
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaagcuggccagaauaccaaguucacacccgauggcguugugcaggacgggaacggaacgcaccaaaaugagccccagcaguggguccucccuuccuacagcggcagaaccgggcauaacgugcaccuggccccggccaucgcucccacauuuccuggagaacagcuucuguucuuucgguccaccaugcccggcuguucuggguacccuaacaugaaucucgauugccugcugccccaagaguggguucagcauuucuaucaggaggccgcgccugcucagagcgacguggcccuccugcgcuuugucaaccccgauacaggcagagugcuuuucgaauguaaacugcacaaguccggauacgugaccguugcccacacgggccaacaugaccucgucauuccgccuaauggguauuuucgguucgauagcugggugaaccaguucuacacccuggcucccaugggaaauggcacagggagacgccgguga

SEQ ID NO: 30007 - RNA, 1617 nt, Artificial Sequence
  derived and/or modified sequence opt5 from VP1__Norovirus_and/or_Norovirus-like__JQ613553
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccguccaggagaugacaaauagcagauuucccaucccgcuugaaaagcuguucaccgggccuucuuccgccuucgugguucagccccaaaacggacgguguacaaccgauggcgugcuccuggggacgacacagcugagcccugucaauauuugcaccuuucgcggagacgugacacauauccccggcucuagaaacuacaccaugaaucucgccucccagaacuggaauagcuaugauccuaccgaggagauccccgcuccgcugggcacaccugacuucgucgggaaaauucagggagugcuuacgcaaaccacacggaccaacggcuccacacgcgggcacaaggcgaccguuuacacgggaucugccgacuuuagccccaagcugggcagagugcaguucgcuacagauaccgacaaugauuuugaaaccaaccagaauacaaaauucacccccgucggggugauccaagacggauccacaacgccucggaacgagccgcagcaguggguucuccccagcuacucuggccgcaauauucauaacgugcaccuggccccugccgucgcucccaccuuuccuggcgaacagcuucuguucuuuagauccacaaugcccggguguagcggauauccuaauauggaucucgacugccugcugccccaagagugggugcaguacuucuaucaggaagccgcgccggcucagucugauguggcccuccugcgguuuguuaacccugacaccggcagaguccuuuucgaguguaagcugcacaaaagcggguacgugacaguggcccauaccggacaacacgaucucgucauucccccuaacggcuauuuucgcuucgacuccugggugaaucaguucuacacgcuggcucccauggggaacggcaccggacggagacgcuga

SEQ ID NO: 30008 - RNA, 1617 nt, Artificial Sequence
  derived and/or modified sequence opt5 from VP1__Norovirus_and/or_Norovirus-like__JQ613521
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagagacuacaccaugaaccucgcgucucugaauuggaacaauuaugauccuaccgaagagacacccgccccucuugggacgcccgacuucgugggaaaaauucagggcaugcugacccagacaaccaagggggacggauccacacggggccacaaggcuaccgucuacacggggagcgccccguuuacaccuaaacucggauccgugcgcuucucuaccgauaccgaaaacgacuuugagacacaucagaauaccaaguucacacccguuggcgugauccaagauggcagcacgacccacagaaacgaaccccagcaguggguccugccuuccuacagcgggcgggacgugcacaauguucaucuugccccggcuguggcccccacauuuccuggagagcaacuccuguucuuucgcucuaccaugcccggcuguuccggguauccuaacauggaucuggacugccugcucccccaggaguggguccagcacuucuaccaggaagcggcuccugcccaaagcgauguggcccugcuuagauuugugaaucccgacacaggacggguucuguucgaguguaaacuccauaagucuggcuaugucaccguggcucacacggggcagcacgaucuggugauuccgccuaacggcuacuuuagauucgacagcugggucaaucaguucuauacccuugcccccaugggaaacggcacagggcgccggagauga

SEQ ID NO: 30009 - RNA, 1617 nt, Artificial Sequence
  derived and/or modified sequence opt5 from VP1__Norovirus_and/or_Norovirus-like__HQ005298
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccugucccgcauguauaauggguacgccggaggcuucgaaguccaggugauccuugcuggcaacgccuuuacggcugggaaaauuaucuucgccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccgggccuuccagcgcuuucgugguucagccccagaacggacgguguacaaccgauggcgugcuccuggggacgacacaacugucuccugucaauauuugcaccuuucgcggagacgugacacauaucuccggcagcagaaacuacaccaugaaucucgccucccagaacuggaacucuuaugaucccaccgaggaaaucccugcuccccugggcacaccggacuucgucgggaaaauucagggagugcuuacgcagaccacacggaccaauggcagcacacgcgggcacaaggccaccguuuacacgggauccgcggacuuuagcccuaagcugggcagagugcaauucgccacagauaccgacaaugauuuugagaccaaccagaauacaaaauucacccccgucggggugauccaggacggaucuacaacgccccggaacgaaccucaacaguggguucucccguccuacagcggccgcaauauucauaacgugcaccuggcucccgccgucgccccuaccuuucccggcgagcagcuucuguucuuuagaucuacaaugccuggguguagcggauaucccaauauggaucucgacugccugcugccucaggaaugggugcaauacuucuaucaggaggcugcccccgcgcaguccgauguggcucuccugcgguuuguuaacccggacaccggcagaguccuuuucgaguguaagcugcacaaaucuggguacgugacaguggcccauaccggacagcacgaucucgucaucccucccaacggcuauuuucgcuucgacagcugggugaaucaauucuacacgcuggccccuauggggaacggcaccggacggagacgcuga

SEQ ID NO: 30010 - RNA, 1617 nt, Artificial Sequence
  derived and/or modified sequence opt5 from VP1__Norovirus_and/or_Norovirus-like__HQ005296
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccugucccgcauguauaauggguacgccggaggcuucgaaguccaggugauccuugcuggcaacgccuuuacggcugggaaaauuaucuucgccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccgggccuuccagcgcuuucgugguucagccccagaacggacgguguacaaccgauggcgugcuccuggggacgacacaacugucuccugucaauauuugcaccuuucgcggagacgugacacauauccccggcuccagaaacuacaccaugaaucucgccagccagaacuggaacuccuaugauccuaccgaggaaauccccgccccgcugggcacaccugacuucgucgggaaaauucagggagugcuuacgcagaccacacggaccaauggcucuacacgcgggcacaaggcuaccguuuacacgggaagcgcggacuuuucccccaagcugggcagagugcaauucgccacagauaccgacaaugauuuugagaccaaccagaauacaaaauucacccccgucggggugauccaggacggaagcacaacgccucggaacgaaccgcaacaguggguucuccccucuuacuccggccgcaauacccauaacgugcaccuggcuccugccgucgcccccacauuuccuggcgagcagcuucuguucuuuagaagcaccaugcccggguguucuggauauccuaauauggaucucgacugccugcugccccaggaaugggugcaauacuucuaucaggaggcugccccggcgcagagcgauguggcucuccugcgguuuguuaacccugacacaggcagaguccuuuucgaguguaagcugcacaaauccggguacgugaccguggcccauacgggacagcacgaucucgucauucccccuaacggcuauuuucgcuucgacucuugggugaaucaauucuacacccuggcccccauggggaacggcacaggacggagacgcuga

SEQ ID NO: 30011 - RNA, 1617 nt, Artificial Sequence
  derived and/or modified sequence opt5 from VP1__Norovirus_and/or_Norovirus-like__HM802555
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggggucuguucaauucgccaccgacacagauaacgacuuugagaccggacagaauacaagauucacgcccgugggcgucauucaggauggcagcuccgcucaucggaacgaaccccaacagugggugcucccugacuacagcgggcgcaccguucacaaugugcaccuggccccggccgucgcucccacauuuccuggagagcagcuucuguucuuuagaucuaccaugcccggcuguuccggguacccuaacauggaucucgacugccugcugccccaggaaugggugcaacauuucuaucaggaggccgcgccugcucagagcgauguggcccuccugcgguuuguuaaucccgacacaggaagaguccuuuucgaguguaagcugcacaaaaccggcuacgugacgguggcccauaccgggcagcacgaucucgucaucccgccuaacggcuauuuucgcuucgacucuugggugaaucaauucuacacacuggcucccaugggaaacggcgccgggcggagacgcuga

SEQ ID NO: 30012 - RNA, 1617 nt, Artificial Sequence
  derived and/or modified sequence opt5 from VP1__Norovirus_and/or_Norovirus-like__GQ246801
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucauugucgacgugagacaacucgagccugugcugaucccccugccugauguccggaauaacuuuuaucauuacaaucagagcaacgaccccaccauuaagcucaucgcuaugcuguauacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacacauccccggcucuagaaauuacaccaugaaccucgccucccagaauuggaacagcuaugauccuaccgaggaaauccccgcuccgcugggcacaccugacuucgucgggaaaauucagggagugcuuacgcagaccacacggaccaauggcuccacacgcgggcauaaggcgaccguuuacacgggaucugccgacuuuagccccaagcugggcagagugcaauucgcuacagauaccgacaacgauuuugagaccaaucagaacacaaaauucacccccgucggggugauccaggacggauccacaacgccucggaaugaaccgcaacaguggguucuccccagcuacucuggccgcaacauucacaaugugcaccuggccccugccgucgcucccaccuuuccuggcgagcagcuucuguucuuuagauccacaaugcccggguguagcggauauccuaacauggaucucgacugccugcugccccaggaaugggugcaauacuucuaucaggaggccgcgccggcucagucugauguggcccuccugcgguuuguuaauccugacaccggcagaguccuuuucgaguguaagcugcauaaaagcggguacgugacaguggccuauaccggacagcacgaucucgucauucccccuaacggcuacuuucgcuucgacuccugggugaaccaauucuauacgcuggcucccauggggaauggcaccggacggagacgcuga

SEQ ID NO: 30013 - RNA, 1617 nt, Artificial Sequence
  derived and/or modified sequence opt5 from VP1__Norovirus_and/or_Norovirus-like__AB504308
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccacggacauaaggcgacggucagcacaggcuccguggauuuuaccccuaaacuggggucuguucaauucgccaccgacacagauaacgacuuugagaccggacagaauacacgcuucacgcccgugggcgucauucaggauggcagcuccgcucacagaaacgaaccccaacagugggugcucccugacuacagcgggcggaccguucacaaugugcaucuggccccggccgucgcucccacauuuccuggagagcagcuucuguucuuucgcucuaccaugcccggcuguuccggguacccuaacauggaucucgacugccugcugccccaggaaugggugcaacacuucuaucaggaggccgcgccugcucagagcgauguggcccuccugagauuuguuaaucccgacacaggacggguccuuuucgaguguaagcugcauaaaaccggcuacgugacgguggcccacaccgggcagcacgaucucgucaucccgccuaacggcuauuuuagauucgacucuugggugaaucaauucuacacacuggcucccaugggaaacggcgccgggcgccggagauga

SEQ ID NO: 30014 - RNA, 1617 nt, Artificial Sequence
  derived and/or modified sequence opt5 from VP1__Norovirus_and/or_Norovirus-like__DQ369797
augaagauggcccccaacgacgcuagcccuuccgauggcucuaccgccaaucuggugccggaggucaacaaugaaguuauggcgcucgagcccguggugggggcugccaucgccgcuccugucgccggacagcaaaacgugauugaccccuggaucagaaauaacuucguucaggcuccuggcggggaauuuacagugagcccccggaaugccccuggagagauucugugguccgcgccgcuuggccccgaucugaacccuuaccucucucaccuggcccgcauguauaauggguacgcuggaggcuucgaaguccaggugauccuugccggcaacgcuuuuacggccgggaaaauuaucuucgcggccguucccccuaauuuucccaccgagggacugagcccgucccaggugacaauguucccucauaucauugucgacgugagacaacucgagcccgugcugaucccucugcccgauguccggaacaauuuuuaucacuacaaccagucuaaugacagcaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucaccguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugagcaucugcacauuucgcggagacgucacccauauccccggcaccagaauuuaccggaugaaucucgccucucagaacuggaauaacuaugauccuacagaggaaauccccgcuccgcugggcacgccugacuucguggggaaaauucagggaaugcuuacccagacaaccaagggcgacggguccacacgcggacacaaggcgaccgucagcacgggcuccguggauuuuacacccaaacuggggucuguucaauucgccaccgacaccgauaaugacuuugagacaggacagaacaccagauucacacccgugggcgucauccaggauggcagcuccgcucaucggaaugaaccucaacagugggugcucccggacuacagcgggcgcacgguucacaacgugcaccuggcccccgccgucgcuccuaccuuucccggagagcagcuucuguucuuuagaucuacaaugccuggcuguuccggguaccccaauauggaucucgacugccugcugccucaggaaugggugcaacauuucuaucaggaggccgcgcccagccagucugauguggcucuccugcgguuuguuaacccggacaccggaagaguccuuuucgaguguaagcugcacaaagccggcuacgugacaguggcccauaccgggcagcacgaucucgucauuccucccaauggcuauuuucgcuucgacagcugggugaaccaauucuacacgcuggcuccuaugggaaauggcgccgggcggagacgcuga

SEQ ID NO: 30015 - RNA, 1617 nt, Artificial Sequence
  derived and/or modified sequence opt5 from VP1__Norovirus_and/or_Norovirus-like__LC177661
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagauccaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuacagauuuugacuucauuuuucucguuccgcccaccguggaaucccgcacgaaaccuuucagcguccccgugcugaccguugaggaaaugacaaacucuagauuuccuaucccccuugagaagcuguucaccgggccguccagcgccuucgugguccagccucagaauggacgguguacaaccgauggcgugcuccuggggacgacacaacugucucccgucaacauuugcaccuuucgcggagacgugacacauaucaccggcuccagaaauuacaccaugaaccucgcuagccagaauuggaacaauuaugauccuacagaggaaauucccgcgccucugggcacgcccgacuucguugggaaaauccagggaaugcuuacccagacaacccggacagacggcuccacccgcgggcacaaggccacgguguacacaggaucugcugauuuugccccgaagcugggcagaguccaauucgagaccgacaccgaucaugacuuugaagccaaccagaauacaaaauucaccccuguggggguuauccaggauggaagcacaacgcaccggaacgagccccaacagugggugcuccccuccuacagcggccgcaauaccccuaacguccaccuggcuccggccguggcgcccacauuuccuggcgaacagcuucuguucuuuagaucuaccaugcccggguguuccggauauccuaauauggaccucgauugccugcugccccaggagugggugcaauacuucuaucaggaggcugccccugcccagagcgacguugcucuccugcgguuugucaaccccgauacaggcagagugcuuuucgaauguaagcugcauaaaucuggguacgugaccgucgcccacacgggacagcaugaccucgugauuccgccuaauggcuauuuucgcuucgauagcuggguuaaccaauucuacacccuggcucccauggggaacggcacaggacggagacgcuga

SEQ ID NO: 30016 - RNA, 1617 nt, Artificial Sequence
  derived and/or modified sequence opt5 from VP1__Norovirus_and/or_Norovirus-like__LC175468
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauccaggauggaagcaccacacaccggaaugagccccaacagugggugcuccccuccuacagcggccgcaacacgcacaauguucaucuggcuccugccguggcgccgaccuuucccggcgaacagcuucuguucuuuagaucuacaaugccuggguguuccggauaucccaacauggaccucgauugccugcugccucaggaguggguccaauacuucuaucaggaggcugcccccgcccagagcgacguggcucuccugcgguuugugaauccugauaccggcagaguucuuuucgaauguaagcugcacaaaucuggguacgucacaguggcccauaccggacagcacgaccucgugauucccccgaacggcuauuuucgcuucgauagcugggucaaccaauucuacacgcuggcuccuauggggaauggcaccggacggagacgcuga

SEQ ID NO: 30017 - RNA, 1617 nt, Artificial Sequence
  derived and/or modified sequence opt5 from VP1__Norovirus_and/or_Norovirus-like__KX354137
augaagauggccagcuccgacgcuaaccccucugauggcagcgccgcgaaucuggugccugaggucuccaacgaaguuauggcucucgagccgguggugggggccgccaucgcugcccccgucgcuggacagcaaaauauuaucgacccuuggauuagaaacaauuucgugcaggcccccggcggggaauuuaccguuucuccucggaacgcgcccggagagauccuguggagcgccccucuuggcccggaucugaaucccuaccucucccaccuggcucgcauguauaacggguacgccggaggcuucgaagugcaggucauucuugcuggcaaugccuuuacagcggggaaaaucaucuucgccgcugugccucccaacuuuccuacggagggacugucucccagccagguuaccauguucccgcauauuaucguggacgucagacaacucgagccugugcugauuccccugccugaugugcggaauaacuuuuaucacuacaaucaguccaacgaccccacaaucaagcucauugccaugcuguauacaccccuucgcgcuaauaacgccggcgaugacgucuucaccguuagcugcagagugcugacccggccuucuccggauuuugacuucaucuuucucgugcccccuacagucgaaucccgcaccaaacccuucagcgugccuauucugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccuguuaacaucugcacauuucgcggagacgugacccauauuacaggcucccacaauuacaccaugaaccucgcuagccagaauuggaacaauuaugaucccaccgaggaaaucccugcgccccugggcacaccggacuucgucgggaaaauucagggagugcuuacgcagaccacaagauccgacggcucuacccgggggcauaaggccacagucuacaccggaagcgcugauuuugccccuaagcugggccgcgugcaauucgagacggacacagauagagacuuugaaaccaaccagaauaccaaauucacacccguuggggugauccaggauggaaccacagcccaccggaacgagccccaacaguggguccucccuuccuacagcggccgcaauauucacaacgugcaucuggcuccggccguugcgcccacguuuccuggcgaacagcuucugucuuucagauccaccaugcccggguguagcggauauccuaauauggaccucgauugccugcugccccaggagugggugcaauacuuuuaucaggaggcugccccugcccagucugacgucgcucuccugcgguucgugaaccccgauacaggcagagugcuuuuugaauguaagcugcacaaaagcggguacguuaccgucgcccauacaggacagcacgaccucgugaucccgccuaauggcuauuuccgcuuugauuccugggugaaccaauucuacacccuggcucccauggggaacggcacgggacggagacgcuga

SEQ ID NO: 30018 - RNA, 1617 nt, Artificial Sequence
  derived and/or modified sequence opt5 from VP1__Norovirus_and/or_Norovirus-like__KX354036
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcuccccugacuucgucgggaaaauucagggagugcuuacacagacgacccggacaaacggcucuacccgcgggcacaaggcgacaguuuacaccggaagcgccgacuuuucccccaagcugggcagagugcaauucgcuacggauacagacaaugauuuugagaccaaccagaauaccaaauucacacccgucggggugauccaggacggaagcaccacaccucggaacgaaccgcaacaguggguucuccccucuuacuccggccgcaauauucauaacgugcaccuggccccugccgucgcucccacguuuccuggcgagcagcuucuguucuuuagaagcaccaugcccggguguucuggauauccuaauauggaucucgacugccugcugccccaggaaugggugcaauacuucuaucaggaggccgcgccggcucagagcgauguggcccuccugcgguuuguuaacccugacacaggcagaguccuuuucgaguguaagcugcacaaauccggguacgugaccguggcccauacaggacagcacgaucucgucauucccccuaacggcuauuuucgcuucgacucuugggugaaucaauucuacacccuggcucccauggggaacggcacgggacggagacgcuga

SEQ ID NO: 30019 - RNA, 1617 nt, Artificial Sequence
  derived and/or modified sequence opt5 from VP1__Norovirus_and/or_Norovirus-like__KX354011
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgacagcaccauuaagcucaucgcuaugcuguauacaccccuucgcgccaauaacgcuggcgaugacguuuucaccgugucuugcagagugcugacacggcccuccccugauuuugacuucauuuuucucgucccgcccaccguggaaagccgcacgaaaccuuucucuguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucccuggcagccacaauuacaccaugaaccucgccucccagaauuggaacucuuaugaucccaccgaggaaauuccugcuccccugggcacaccggacuucguggggaaaauccagggaguccuuacgcagaccacaagcaccaauggcuccacaagagggcauaaggcgaccguguacacgggaagcgccgacuuuucuccuaagcugggccggguucaauucgcuacagauaccaacaaugacuuugagaccaaccagaauacaaaauucacccccgugggggucauucaggauggauccacaacgccccgcaacgaaccucaacagugggugcucccgagcuacucuggcagaaauauccacaacguucaccuggcccccgccguggcuccuaccuuucccggcgagcagcuucuguucuuucggagcacaaugccuggguguuccggauaucccaauauggaccucgauugccugcugccucaggaauggguccaauacuucuaucaggaggccgcgcccgcucagucugacguggcccuccugcgcuuugugaacccggauaccggcagaguucuuuucgaguguaagcugcauaaaagcggguacgucacaguggcccacaccggacagcaugaccucgugauuccucccaacggcuauuuucgguucgauuccugggucaaucaauucuacacgcuggcuccuauggggaacggcaccggaagacgccgguga

SEQ ID NO: 30020 - RNA, 1617 nt, Artificial Sequence
  derived and/or modified sequence opt5 from VP1__Norovirus_and/or_Norovirus-like__LC153122
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgucagccagaacuggaauaacuaugauccuaccgaggaaauccccgcuccucugggcacacccgacuucguggggaaaauucagggaaugcuuacgcagaccacacggaccgacggcuccacacgcgggcacaaggcgaccguuuacacgggaucugccgauuuugcuccgaagcugggcagagugcaauucgagacagacaccgaucaugacuuugaagccaaucagaacaccaaauucacaccugucggggugauccaggauggaagcaccacacaccggaaugagccccaacaguggguucuccccuccuacagcggccgcaacacgcacaaugugcaucuggccccugcugucgccccgaccuuucccggcgaacagcuucuguucuuuagaucuacaaugccuggguguuccggauaucccaacauggaccucgauugccugcugccucaggagugggugcaauacuucuaucaggaggcggcucccgcccagagcgacguggcccuccugcgguuuguuaauccugauaccggcagaguccuuuucgaauguaagcugcacaaaucuggguacgugacaguggcucauaccggacagcacgaccucgucauucccccgaacggcuauuuucgcuucgauagcugggugaaccaauucuacacgcuggccccuauggggaauggcaccggacggagacgcuga

SEQ ID NO: 30021 - RNA, 1617 nt, Artificial Sequence
  derived and/or modified sequence opt5 from VP1__Norovirus_and/or_Norovirus-like__KR131777
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggagcuccuaugauccuaccgaggaaauccccgcuccgcugggcacaccugacuucgucgggaaaauucagggagugcuuacgcagaccacacggaccaauggcucuacacgcgggcacaaggcgaccguuuacacgggaagcgccgacuuuucccccaagcugggcagagugcaauucgcuacagauaccgacaacgauuuugagaccaaucagaacacaaaauucacccccgucggggugauccaggacggaagcacaacgccucggaaugaaccgcaacaguggguucuccccucuuacuccggccgcaacauucauaaugugcaccuggccccugccgucgcucccaccuuuccuggcgagcagcuucuguucuuuagaagcacaaugcccggguguucuggauauccuaacauggaucucgacugccugcugccccaggaaugggugcaauacuucuaucaggaggccgcgccggcucagagcgauguggcccuccugcgguuuguuaauccugacaccggcagaguccuuuucgaguguaagcugcacaaauccggguacgugacaguggcccauaccggacagcacgaucucgucauucccccuaacggcuauuuucgcuucgacucuugggugaaccaauucuacacgcuggcucccauggggaauggcaccggacggagacgcuga

SEQ ID NO: 30022 - RNA, 1617 nt, Artificial Sequence
  derived and/or modified sequence opt5 from VP1__Norovirus_and/or_Norovirus-like__AB933764
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagcucaaugaccccaccauuaagcugaucgcuaugcuuuauacaccccugcgcgccaacaacgcuggcgaugacguuuucaccgugagcugcagagugcucacacggccuuccccggauuuugacuucauuuuucuggugcccccuaccgucgaaagccgcacgaaacccuucucuguuccugugcuuaccgucgaggaaaugacaaauuccagauuucccaucccgcuggagaagcuguucaccgggccuagcucugccuucgugguucagccccagaacggacgguguacaaccgauggcgugcugcuggggacgacacaacucuccccugucaauauuugcaccuuucgcggagacgugacacauauccccggcagcagaaacuacaccaugaaucuggccucucagaacuggaacuccuaugauccuaccgaggaaauccccgcuccgcuuggcacaccugacuucgucgggaaaauucagggagugcugacgcagaccacacggaccaauggcagcacacgcgggcacaaggcgaccguuuacacgggauccgccgacuuuucucccaagcucggcagagugcaauucgcuacagauaccgacaaugauuuugagaccaaccagaauacaaaauucacccccgucggggugauccaggacggaagcacaacgccucggaacgaaccgcaacaguggguucugcccuccuacagcggccgcaauauucauaacgugcaccuugccccugccgucgcucccaccuuuccuggcgagcagcuccucuucuuuagaucuacaaugcccggguguuccggauauccuaauauggaucuggacugccugcucccccaggaaugggugcaauacuucuaucaggaggccgcgccggcucagagcgauguggcccugcuucgguuuguuaacccugacaccggcagaguccuguucgaguguaagcuccacaaaucuggguacgugacaguggcccauaccggacagcacgaucuggucauucccccuaacggcuauuuucgcuucgacagcugggugaaucaauucuacacgcuugcucccauggggaacggcaccggacggagacgcuga

SEQ ID NO: 30023 - RNA, 1617 nt, Artificial Sequence
  derived and/or modified sequence opt5 from VP1__Norovirus_and/or_Norovirus-like__LC016600
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccucuacauacagaaugaaccucgccucccagaauuggaacaauuaugaucccacggaggaaauuccugcuccccugggcaccccggacuucguggggaaaauccagggaaugcuuacacagaccacaaagggcgacgggagcacccggggacacaaggcgacggucuccacaggcucuguggauuuuaccccuaaacuggggagcguucaauucgccaccgacacagauaacgacuuugagaccggacagaauacacgcuucacgcccgugggcgucauucaggauggcuccggggcucauagaaacgaaccccaacagugggugcucccuaauuacagcggacggaccguucacaacgugcaccuggccccggccgucgcucccacauuuccuggcgagcagcuucuguucuuucgcucuaccaugcccggguguuccggauacccuaauauggaccucgauugccugcugccccaggaaugggugcaacauuucuaucaggaggccgcgccugcucagagcgacguggcccuccugagauuuguuaaccccgauacaggccggguccuuuucgaguguaagcugcacaaaaccggguacgugacgguggcccauaccggccagcacgaccucgucaucccgccuaauggauauuuuagauucgauucuugggugaaccaauucuacacacuggcucccaugggcaacggggccggacgccggagauga

SEQ ID NO: 30024 - RNA, 1617 nt, Artificial Sequence
  derived and/or modified sequence opt5 from VP1__Norovirus_and/or_Norovirus-like__KJ433970
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccacacaccggaacgagccccaacaguggguccucccuuccuacagcggccgcaauacgccgaacgugcaccuggcucccgccguggcgccuaccuuucccggcgaacagcuucuguucuuuagaucuacaaugccuggguguuccggauaucccaauauggaccucgauugccugcugccucaggaguggguucaauacuucuaucaggaggcugcccccgcccagagcgacgucgcucuccugcgguuugugaacccggauaccggcagagugcuuuucgaauguaagcugcauaaaucucgcuacgucacaguggcccacaccgggcagcaugaccucguuauuccucccaauggauauuuucgguucgauagcugggugaaccaauucuacacgcuggcuccuaugggcaacgggaccggcagacgccgguga

SEQ ID NO: 30025 - RNA, 1617 nt, Artificial Sequence
  derived and/or modified sequence opt5 from VP1__Norovirus_and/or_Norovirus-like__KP176395
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucuguggauuuugcuccuaagcugggcagaguucaauucgagacagacaccgaucaugacuuugaagccaaccagaauaccaaauucacacccgugggggucauccaggauggaagcaccacacaccggaacgagccccaacagugggugcucccuuccuacagcggccgcaauacgccgaacgugcaccuggcccccgcuguugccccuaccuuucccggcgaacagcuucuguucuuuagaucuacaaugccuggguguuccggauaucccaauauggaccucgauugccugcugccucaggaguggguccaauacuucuaucaggaggcggcucccgcccagagcgacguggcccuccugcgguuugugaacccggauaccggcagaguccuuuucgaauguaagcugcauaaaucuggguacgugacaguugcucacaccggacagcaugaccucgugauuccucccaauggcuauuuucgcuucgauagcugggucaaccaauucuacacgcuggccccuauggggaacggcaccggacggagacgcuga

SEQ ID NO: 30026 - RNA, 1617 nt, Artificial Sequence
  derived and/or modified sequence opt5 from VP1__Norovirus_and/or_Norovirus-like__KM982947
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgccguggacgugagacaacucgagccuguccugaucccccugccugauguucggaacaauuuuuaucacuacaaccagagcaaugaccccacaauuaagcucaucgcuaugcuguauacaccccuucgcgccaacaacgccggcgaugacguguucaccguguccugcagaguccugacccggccuagcccggauuuugacuucauuuuucucgugcccccuacaguugaaucucgcaccaaacccuucuccgugccuguccugacgguggaggaaaugaccaauagcagauuucccaucccgcuugagaagcuguucacagggccuucuuccgcuuucguugugcagccccagaacggacgguguaccacagauggcguccuccuggggaccacgcaacugagcccugugaauauuugcacauuucgcggagacgucacccauaucacaggcucuagaaacuacaccaugaaucucgcgucccagaacuggagcaauuaugaucccaccgaggaaauuccugcuccccugggcacaccggacuucguggggaaaauccagggaguucuuacgcagaccacacggaccgacggcuccacacgcgggcacaaggccaccguguacacgggaucugccgauuuugccccuaagcugggcagaguccaauucgagacagacaccgaucaugacuuugaagcuaaccagaauaccaaauucacacccguggggguuauccaggauggaggcaccacacaccggaacgagccccaacagugggugcucccuagcuacuccggccgcaauacgccgaacguccaccuggcccccgcgguggcuccuaccuuucccggggaacagcuucuguucuuuagaagcacaaugccuggauguucuggcuaucccaauauggaccucgauugccugcugccucaggagugggugcaauacuucuaucaggaggccgcccccgcucaguccgacguugcccuccugcgguuugucaacccggauaccgggagagugcuuuucgaauguaagcugcauaaaagcggauacgugacagucgcucacaccggccagcaugaccucgugauuccucccaauggguauuuucgcuucgauucuuggguuaaccaauucuacacgcuggccccuaugggcaacggaaccggccggagacgcuga

SEQ ID NO: 30027 - RNA, 1617 nt, Artificial Sequence
  derived and/or modified sequence opt5 from VP1__Norovirus_and/or_Norovirus-like__KJ685414
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcuccgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauauccccggcuccagaaauuacaccaugaaccucgccagccagaauuggaacuccuaugauccuaccgaggaaauccccgcuccgcugggcacaccugacuucgucgggaaaauucagggagugcuuacgcagaccacacggaccaauggcucuacacgcgggcacaaggcgaccguuuacacgggaagcgccgacuuuucccccaagcugggcagagugcaauucgcuacagauaccgacaacgauuuugagaccaaucagaacacaaaauucacccccgucggggugauccaggacggaagcacaacgccucggaaugaaccgcaacaguggguucuccccucuuacuccggccgcaacauucauaaugugcaccuggccccugccgucgcucccaccuuuccuggcgagcagcuucuguucuuuagaagcacaaugcccggguguucuggauauccuaacauggaucucgacugccugcugccccaggaaugggugcaauacuucuaucaggaggccgcgccggcucagagcgauguggcccuccugcgguuuguuaauccugacaccggcagaguccuuuucgaguguaagcugcacaaauccggguacgugacaguggcccauaccggacagcacgaucucgucauucccccuaacggcuauuuucgcuucgacucuugggugaaccaauucuacacgcuggcucccauggggaauggcaccggacggagacgcuga

SEQ ID NO: 30028 - RNA, 1617 nt, Artificial Sequence
  derived and/or modified sequence opt5 from VP1__Norovirus_and/or_Norovirus-like__KF060093
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucaccaaucagaacacaaaauucacccccguggggguuauccaggauggaaauacaacgccccggaacgagccucaacagugggugcucccgagcuacucuggccgcaauacccauaacguccaccuggcccccgccguggcuccuacauuucccggcgaacagcuucuguucuuuagauccaccaugccuggguguagcggauaucccaauauggaccucgauugccugcugccucaggagugggugcaauacuucuaucaggaagccgcgcccgcucagucugacguugcccuccugcgguuugucaacccggauacaggcagagugcuuuucgaguguaagcugcacaaaccuggguacgugaccgucgcccauacgggacagcacgaccucgugauucccccuaacggcuauuuucgcuucgauagcuggguuaaucaauucuacacccuggcucccauggggaacggcacaggacggagacgcuga

SEQ ID NO: 30029 - RNA, 1617 nt, Artificial Sequence
  derived and/or modified sequence opt5 from VP1__Norovirus_and/or_Norovirus-like__KC456070
augaagauggccagcuccgacgcuaaccccucugauggcagcgccgcgaaucuggugccuaaagucaacaaugagguuauggcucucgaaccgguggugggggccgccaucgcugcccccgucgcuggacagcaaaacgugauugacccuuggaucaagaauaacuucguucaggcccccggcggggaguuuaccguguccccuaaaaaugcgcccggagaaauucuguggucugccccucuuggcccggaucugaaccccuaccucagccaccuggcuaagauguauaauggguacgccggaggcuucgagguccaggugauccuugcuggcaacgccuuuacagcggggaaaguuauuuucgccgcugugccucccaauuuuccuacggaaggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggagucucgcaccaagcccuucuccgucccugugcugacgguugaagagaugaccaauagcagauuucccaucccgcuugaaaaacuguucacagggccuucuuccgccuucgugguccagccccagaacggacgguguaccacagauggcgugcuccuggggaccacgcaacugagcccugucaauauuugcacauuucgcggagacgugacccauacaaucggcucuagaaacuacaccaugaaucucgcuucccagaacuggaauaacuaugaucccaccgaggagauuccugcgccccugggcacaccggacuucguugggaagauccagggagugcuuacgcagaccacacggaccgacggcagcacacgcgggcacaaagccaccgucuacacgggauccgcugauuuugccccuaagcugggcagagugcaauucgaaacagacaccgaucaugacuuugaggccaaucagaacaccaaauucacacccguuggggugauccaggauggaucuaccacacaccggaaugaaccccaacaguggguccucccuagcuacuccggccgcaacacgcacaaugugcaucuggcuccggccguggcgcccaccuuuccuggcgagcagcuucuguucuuuagaagcacaaugcccggguguucuggauauccuaacauggaccucgauugccugcugccccaggaauggguucaauacuucuaucaggaggcugccccugcccaguccgacgucgcucuccugcgguuugugaaucccgauaccggccgcgugcuuuucgaguguaagcugcacaagagcggguacgucacaguggcccauaccggacagcacgaccucguuauuccgccuaacggcuauuuuagauucgauucuugggugaaccaauucuacacgcuggcucccauggggaauggcaccggacggagacgcuga

SEQ ID NO: 30030 - RNA, 1617 nt, Artificial Sequence
  derived and/or modified sequence opt5 from VP1__Norovirus_and/or_Norovirus-like__KC409299
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuaacgccuucgugguucagccccagaauggacgguguacaaccgauggcgugcuccuggggacgacacaacuguccccugucaacauuugcaccuuucgcggagacgugacacauauccccggcagcagaaauuacaccaugaaccucgccucucagaauuggaacuccuaugauccuaccgaggaaauccccgcuccgcugggcacaccugacuucgucgggaaaauucagggagugcuuacgcagaccacacggaccaauggcagcacacgcgggcacaaggcgaccguuuacacgggauccgccgacuuuucucccaagcugggcagagugcaauucgcuacagauaccgacaacgauuuugagaccaaucagaacacaaaauucacccccgucggggugauccaggacggaagcacaacgccucggaaugaaccgcaacaguggguucuccccuccuacagcggccgcgaugugcauaacguccaccuggccccugccguggcucccaccuuuccuggcgagcagcuucuguucuuuagaucuacaaugcccggguguuccggauauccuaauauggaccucgauugccugcugccccaggaaugggugcaauacuucuaucaggaggccgcgccggcucagagcgacguugcccuccugcgguuugucaacccugauaccggcagagugcuuuucgaguguaagcugcacaaaucuggguacgugacagucgcccauaccggacagcacgaccucgugauucccccuaacggcuauuuucgcuucgauagcuggguuaaucaauucuacacgcuggcucccauggggaacggcaccggacggagacgcuga

SEQ ID NO: 30031 - RNA, 1617 nt, Artificial Sequence
  derived and/or modified sequence opt5 from VP1__Norovirus_and/or_Norovirus-like__JX984947
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcucugacuuugauuucauuuuucucgucccuccgacaguggagucccgcaccaaacccuucacgguuccuauccugaccguggaagagaugacaaacagcagauuucccauuccucuugagaagcuguucaccgggcccucuuccgccuucgucgugcagccgcagaauggacgguguacaaccgacggcguucuccuggggacgacacaacugagcccugugaauaccugcacauuucgcggagaugucacccauaucgcuggcucuagaaacuacaccaugaaccucgcgucccugaauuggaacaauuaugaccccacagaagagaucccugcuccccuuggcacgccugauuucguggggaaaauucagggaguccugacccagacaaccaagggcgacgggagcacacggggacacaaggccaccaucuacacgggcuccgcccccuuuacaccgaaacucgggucugugcaguucaacaccgacaccgaaaaugauuuugagacacaucaaaacaccaaguucacaccuguuggagugauucaggacggcggcacgacccaccgcaaugaaccccagcaauggguccugcccagcuacuccgggagaaacaucccuaaugugcaccuugccccggcuguugcccccacauuuccuggagagcagcuccuguucuuucggagcaccaugcccggcuguucuggguauccuaacauggaucuggacugccugcucccccaggagugggugcagcauuucuaccaagaagcggcuccugcccaguccgaugucgcccugcuucgcuuugugaaccccgacacaggaagagugcuguucgaguguaaacuccacaagagcggcuauguuaccgucgcucauacggggcagcacgaucuggugauuccgccuaauggcuacuuucgguucgacucuugggugaaccaguucuauacccuugcccccaugggaaauggcacagggagacgccgguga

SEQ ID NO: 30032 - RNA, 1617 nt, Artificial Sequence
  derived and/or modified sequence opt5 from VP1__Norovirus_and/or_Norovirus-like__KC175385
augaagauggccagcuccgacgcuaaccccucuaauggcagcaccgccaaccuggugccugaggucaauaacgaaguuauggcgcucgagccgguggugggggcugccaucgccgcucccgucgccggacagcaaaaugugaucgauccuuggaucagaaacaauuucguucaggcucccggcggggaauuuacaguguccccucggaacgcccccggagagauucuguggucugcgccucuuggcccggaccugaaucccuaccucagccaccuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcauaucauugucgaugugagacaacucgagccugugcugaucccccugccugacguccggaauaacuuuuaucacuacaaucagagcaacgaucccaccauuaagcucaucgcuaugcuguauacaccccuucgcgccaacaaugcuggcgacgauguuuucaccguguccugcagagugcugacacggccuagcccggacuuugauuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgacggcgugcuccuggggacgacacaacugagcccugucaacauuugcaccuuucgcggagaugugacacauauccccucuucccacaauuacaccaugaaccucgccagccagaauuggaacuccuaugacccuaccgaggaaauccccgcuccgcugggcacaccugauuucgucggcaaaauucagggggugcuuacgcagaccacaagaaccgacggaucuacacggggccauaaggcgaccguuuacacggggagcgccgacuuuucccccaagcugggacgcgugcaauucgcuacagauaccgacaaugauuuucagaccaaccagaauacaaaauucacccccgucggcgugauccaagacgggagcacaacgccuagaaacgagccgcagcaguggguucuccccucuuacuccggacggaauauucacaacgugcaccuggccccugccgucgcucccaccuuuccuggcgaacagcuucuguucuuucgcagcacaaugcccggcuguucuggguauccuaauauggaucucgacugccugcugccccaagagugggugcaguacuucuaucaggaagccgcgccggcucagagcgauguggcccuccugagauuuguuaacccugacaccggacggguccuuuucgaguguaagcugcauaaauccggcuacgugacaguggcccacaccgggcaacaugaucucgucauucccccuaacggauauuuuagauucgacucuugggugaaucaguucuacacgcuggcucccaugggcaacgggaccggccgccggagauga

SEQ ID NO: 30033 - RNA, 1617 nt, Artificial Sequence
  derived and/or modified sequence opt5 from VP1__Norovirus_and/or_Norovirus-like__JQ613563
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaugaucgucgacgugagacaacucgagccugugcugauuccccugccugauguccggaacaauuuuuaucacuacaaccagagcaaugaccccaccaucaagcucauugcuaugcuguauacaccccuucgcgccaacaacgcuggcgaugacguuuucaccguguccugcagagugcugacacggccuagcccggauuuugacuucaucuuucucgugcccccuaccgucgaaucucgcacgaaacccuucuccguuccugugcugaccgucgaggaaaugacaaauagcagauuucccauuccgcuugagaagcuguucaccgggccuucuuccgccuucgugguucagccccagaacggacgguguacaaccgauggcgugcuccuggggacgacacaacugagcccugucaauaucugcaccuuucgcggagacgugacacauacccccggcucucacaacuacaccaugaaucucgccucccagaacuggaauagcuaugauccuacagaggaaauucccgcuccgcugggcacgccugacuucgucgggaaaauccagggagugcuuacccagacaaccagaacaaacggcuccacccgggggcauaaggcgacgguuuacacaggaucugccgacuuuagccccaagcugggccgcgugcaauucgcuaccgauaccgacaaugauuuugagacaaaccagaauaccaaauucacacccgucggggugauccaggacggauccacgaccccuagaaacgaaccgcaacaguggguucuccccagcuacucuggccggaauauucacaacgugcaccuggccccugccgucgcucccacauuuccuggcgagcagcuucuguucuuucgcuccaccaugcccggguguagcggauauccuaauauggaucucgacugccugcugccccaggaaugggugcaauacuucuaucaggaggccgcgccggcucagucugauguggcccuccugagauuuguuaacccugacacaggccggguccuuuucgaguguaagcugcauaaaagcggguacgugaccguggcccacacgggacagcaugaucucgucauucccccuaacggcuauuuuagauucgacuccugggugaaucaauucuacacccuggcucccauggggaacggcacaggacgccggagauga

SEQ ID NO: 30034 - RNA, 1617 nt, Artificial Sequence
  derived and/or modified sequence opt5 from VP1__Norovirus_and/or_Norovirus-like__JQ613558
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaaagcggguacgugacaguggcccauaucggacaguaugaucucgucauucccccuaacggcuacuuucgcuucgacuccugggugaaucaauucuauacccuggcucccauggggaacggcacgggacggagacgcuga

SEQ ID NO: 30035 - RNA, 1617 nt, Artificial Sequence
  derived and/or modified sequence opt5 from VP1__Norovirus_and/or_Norovirus-like__GQ856451
augaagauggccagcaacgacgcuaaucccuccgauggcucuguggccaaccuggucccugagguuaauaacgaagugauggcgcucgagccgguggucggggcugccaucgccgcucccguggccggacagcaaaauguuauugacccuuggaucagaaacaauuucgugcaggcucccggcggggaauuuaccgucagcccucggaacgcccccggagagauucugugguccgcgccucuuggcccggaucugaaucccuaccucucucaccuggcccgcauguauaacggguacgcuggaggcuucgaagugcagguuauccuugccggcaaugcuuuuacagccgggaaaauuaucuucgcggccgugccucccaacuuuccuacggagggacugagccccucccaggucaccauguucccgcauaugaucguggacgugagacaacucgagccuguccugauuccccugccugauguucggaauaacuuuuaucacuacaaucagucuaacgacagcacaaucaagcucauugcuaugcuguauacaccccuucgcgccgauaacgcuggcgaagacguguucaccguguccugcagaguccugacccggcccagcccugauuuugacuucaucuuucucgugccgcccacaguugagucuaaaaccaagccuuucacggugcccauucugaccgucgaagagaugacaaauucccgcuuuccuaucccccuugagaaacuguucaccgggccgagcucuacauucgugguucagccucagaacggaagauguaccacggauggcgugcuccuggggacaacccaacugucccccgucaauauuugcacauuucggggagacgugacccauaucgccggcagccgcaacuacaccaugaaucucgccucucugaacuggaauaacuaugauccuacagaagagauccccgcuccucuuggcacgcccgacuucgucgggaagauucagggagugcugacccagacaaccaagggcgacggguccacaagaggacacaaagcgaccguuuacacgggcagcgccccguuuacaccuaagcucggguccgugcaguucucuaccgauaccgaaaaugacuuugagacacaucaaaacaccaaauucacacccgucggagugauccaggauggcagcacgacccaccggaaugaaccccagcaauggguucugccuuccuacagcggccgcaacgugcacaauguccaucuugcuccggccguggcccccacauuuccuggggagcagcuccuguucuuuagaucuaccaugcccggauguuccggcuauccuaacauggaccuggauugccugcucccccaggagugggugcagcacuucuaccaagaagcugccccugcgcagagcgacguugcucugcuucgguuugucaaucccgauacagggcgcgugcuguucgaguguaagcuccauaaaucuggauaugugaccgucgcccacacgggccagcacgaccuggugauuccgccuaacggguacagcagauuugauuccuggguuaaccaguucuauacccuugcccccaugggcaauggaacaggccggagacgcuga

SEQ ID NO: 30036 - RNA, 1617 nt, Artificial Sequence
  derived and/or modified sequence opt5 from VP1__Norovirus_and/or_Norovirus-like__DQ419908
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggacucuguucaauucgccaccgauacagacaacgauuuugagaccgggcagaauacaagauucacgcccgugggagucauucaggacggcagcuccgcucaucggaacgaaccccaacagugggugcucccugauuacagcggccgcaccguucacaaugugcaccuggccccggccgucgcucccacauuuccuggggagcagcuucuguucuuuagaucuaccaugcccggauguuccggcuacccuaacauggaccucgauugccugcugccccaggaaugggugcaacauuucuaucaggaggccgcgccuagccagucugacguggcucuccugcgguuuguuaaucccgauacagggagaguccuuuucgaguguaagcugcacaaagccggauacgugaccguggcccauacgggccagcacgaccucgucaucccgccuaacggguauuuucgcuucgacagcugggugaaucaauucuacacccuggcucccaugggcaacggagccggccggagacgcuga

SEQ ID NO: 30037 - RNA, 1617 nt, Artificial Sequence
  derived and/or modified sequence opt5 from VP1__Norovirus_and/or_Norovirus-like__KX514354
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccguccaggagaugacgaacucuagauuuccugccacccuugauaagcuguucacagggcccuccagcacccucgugguucagccgcaaaauggacgguguaugaucgacggcgugcugcuggggacaacccagcucucuccugucaacauuugcacguuccgcggagaugugacacauuccagagacagcaccaucuacacaaugaaucuggcuucccccaacuggaauaacuaugacccuaccgaagagauccccgcgccucuuggcacccccgauuuugucggcaaaauucagggggugcugacacagacgaccaagggagagggcucuacacgggggcaccgcgccaccguuuacgugggaagcgcuaauuacacaccgaagcucggcaaaguccaauucgaaaccaacacgacaaaugaccuguaugcccaucagaacaccagauuuaccccuguggggguugugcagggaggcgaguccgcccaccggagcgaaccccaacaguggguccuucccucuuacuccggccgcgauacaccuaaugugcaccuggcuccggccguggcgcccaccuucccuggggagcagcuccuguuuuucagaagcacaauccccggauguggcgggcauccuaacauggaccuggauugccuccugccccaggaauggguucaacacuuuuaucaggaggcugccccugcccagucugacgucgcccuucugcgguucgugaaucccgauacgagcagagugcucuuugaguguaagcugcauaaauccggauacgucaccguggcucacacaggccagcacgaccuuguuauuccgccuaacggguauuuccgcuuugauucuugggugaaccaauucuacacccuggcucccaugggcaauggaacaggccggaagagauga

SEQ ID NO: 30038 - RNA, 1617 nt, Artificial Sequence
  derived and/or modified sequence opt5 from VP1__Norovirus_and/or_Norovirus-like__KX354062
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuaacucccacaauuacaccaugaaccucgccagccagaauuggaacuccuaugaucccaccgaggaaauuccugcuccccugggcacaccggacuucgugggcaaaauccaggggguccuuacgcagaccacaucuaccaauggaagcacaagaggccauaaggcgaccguguacacgggguccgccgacuuuagcccuaagcugggacggguucaauucgcuacagauaccaacaaugacuuugagaccaaccagaauacaaaauucacccccgugggcgucauucaggaugggucuacaacgccccgcaacgaaccucaacagugggugcucccguccuacagcggaagaaauauccacaacguucaccuggcccccgccguggcuccuaccuuucccggcgagcagcuucuguucuuucggucuacaaugccuggcuguagcggguaucccaacauggaccucgauugccugcugccucaggaauggguccaauacuucuaucaggaggccgcgcccgcucaguccgacguggcccuccugcgcuuugugaauccggauaccggaagaguucuuuucgaguguaagcugcauaaaucuggcuacgucacaguggcccacaccgggcagcaugaccucgugauuccucccaacggauauuuucgguucgauagcugggucaaucaauucuacacgcuggcuccuaugggcaacgggaccggcagacgccgguga

SEQ ID NO: 30039 - RNA, 1617 nt, Artificial Sequence
  derived and/or modified sequence opt5 from VP1__Norovirus_and/or_Norovirus-like__AB972532
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuaucccccuugagaagcuguucacagggccguccagcgccuucgugguccagccucagaacggacgguguaccacagauggcgugcuccuggggaccacgcaacugucucccgucaauauuugcacauuucgcggagacgugacccauaucacaggcuccagaaacuacaccaugaaucucgcuagccagaacugguccaauuaugauccuaccgaggaaauucccgcgccucugggcacacccgacuucguugggaaaauccagggagugcuuacgcagaccacacggaccgacggcucuacacgcgggcacaaggccaccgucuacacgggaagcgcugauuuugccccgaagcugggcagagugcaauucgagacagacaccgaucaugacuuugaagccaaccagaauaccaaauucacaccuguuggggugauccaggauggauccaccacacaccggaacgagccccaacaguggguccuccccagcuacucuggccgcaauacgccuaacgugcaccuggcuccggccguggcgcccaccuuuccuggcgaacagcuucuguucuuuagauccacaaugcccggguguagcggauauccuaauauggaccucgauugccugcugccccaggaguggguucaauacuucuaucaggaggcugccccugcccagucugacgucgcucuccugcgguuugugaaccccgauaccggcagagugcuuuucgaauguaagcugcauaaaagcggguacgucacaguggcccacaccggacagcaugaccucguuauuccgccuaauggcuauuuucgcuucgauuccugggugaaccaauucuacacgcuggcucccauggggaacggcaccggacggagacgcuga

SEQ ID NO: 30040 - RNA, 1617 nt, Artificial Sequence
  derived and/or modified sequence opt5 from VP1__Norovirus_and/or_Norovirus-like__KT202796
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggaccucgauugccugcugccucaggaguggguucaauacuucuaucaggacgcugcccccgcccaguccgaugucgcucuccugcgguuugugaacccggacaccgggagagugcuuuucgaguguaagcugcauaaaagcggauacgucacaguggcccacaccggccagcaugaucucguuauuccucccaauggguauuuucgcuucgacucuugggugaaccaauucuacacgcuggcuccuaugggcaacggaaccggccggagacgcuga

SEQ ID NO: 30041 - RNA, 1617 nt, Artificial Sequence
  derived and/or modified sequence opt5 from VP1__Norovirus_and/or_Norovirus-like__AB933751
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaacaaucagaacaccaaauucacacccgucggggugauccaggacggauccaccacaccucggaaugaaccgcaacaguggguucuccccagcuacucuggccgcaacauucauaaugugcaccuggccccugccgucgcucccacguuuccuggcgagcagcuucuguucuuuagauccaccaugcccggguguagcggauauccuaacauggaucucgacugccugcugccccaggaaugggugcaauacuucuaucaggaggccgcgccggcucagucugauguggcccuccugcgguuuguuaacccugacacaggcagaguccuuuucgaguguaagcugcacaaaagcggguacgugaccguggcccauacaggacagcacgaucucgucauucccccuaauggcuauuuucgcuucgacuccugggugaaccaauucuacacccuggcucccauggggaauggcacgggacggagacgcuga

SEQ ID NO: 30042 - RNA, 1617 nt, Artificial Sequence
  derived and/or modified sequence opt5 from VP1__Norovirus_and/or_Norovirus-like__KM514078
augaagauggccagcuccgacgcuaaccccucugauggcagcgccgcgaaucuggugccugaggucaacaaugaaguucucgcucuggagccgguggugggggccgccaucgcugcccccgucgcuggacagcaaaacgugauugacccuuggaucagaaauaacuucguucaggcccccggcggggaauuuaccguguccccucggaaugcgcccggagagauucuuuggucugccccucugggcccggaucucaaccccuaccugagccaccuugcucgcauguauaauggguacgccggaggcuucgaaguccaggugauccuggcuggcaacgccuuuacagcggggaaaguuauuuucgccgcugugccucccaauuuuccuacggagggacucucccccucucaggucaccauguucccgcauaucgugguggacgucagacaacuggagccuguucugaucccccucccugaugugcggaacaauuuuuaucacuacaaccagagcaaugaccccacaauuaagcugaucgccaugcuuuauacaccccugcgcgcuaacaacgccggcgaugacguguucaccgucuccugcagagugcucacccggccuagcccggauuuugacuucauuuuucugguucccccuacaguggaaucucgcaccaaacccuucuccgucccugugcuuacgguugaggaaaugaccaauagcagauuucccaucccgcuggagaagcuguucacagggccuucuuccgccuucgugguccagccccagaacggacgguguaccacagauggcgugcugcuggggaccacgcaacucagcccugucaauauuugcacauuucgcggagacgugacccauaucacaggcucuagaaacuacaccaugaaucuggcuucccagaacuggagcaauuaugaucccaccgaggaaauuccugcgccccuuggcacaccggacuucguugggaaaauccagggaaugcugacgcagaccacacggaccgacggcuccacacgcgggcacaaggccaccguguacacgggaucugcugauuuugccccuaagcucggcagaguccaauucgagacagacaccgaucaugacuuugaagccaaccagaauaccaaauucacacccguggggguuauccaggauggaagcaccacacaccggaacgagccccaacagugggugcugccuuccuacagcggccgcaauacgccgaacguccaccuugcucccgccguggcgccuaccuuucccggcgaacagcuccucuucuuuagaucuacaaugccuggguguuccggauaucccaauauggaccuggauugccugcucccucaggagugggugcaauacuucuaucaggaggcugcccccgcccagagcgacguugcucugcuucgguuugucaacccggauaccggcagagugcuguucgaauguaagcuccauaaaucuggguacgugacagucgcccacaccggacagcaugaccuggugauuccucccaauggcuauuuucgcuucgauagcuggguuaaccaauucuacacgcuugcuccuauggggaacggcaccggacggagacgcuga

SEQ ID NO: 30043 - RNA, 1617 nt, Artificial Sequence
  derived and/or modified sequence opt5 from VP1__Norovirus_and/or_Norovirus-like__KM198569
augaagauggccagcaacgacgcuaaucccuccgauggcucugccgcgaaccuggugccugaggucagcaaugaaguuauggcucucgagccgguggccggggccgcuaucgccgcucccguggccggacagcaaaacgucauugacccuuggaucagaaauaacuucgugcaggcgcccggcggggaauuuaccguuuccccucggaaugcccccggagagauucuguggucugcuccucuuggcccggaucugaaccccuaccucagccaccuggcccgcauguauaauggguacgcuggaggcuucgaagugcaggucauccuugccggcaacgcguuuacagccgggaaaauuaucuucgcugccgugccucccaauuuuccuacggagggacugucccccucucagguuaccauguucccgcauaucauuguggacgucagacaacucgagccugugcugaucccccugccugaugugcggaacaauuuuuaucacuacaaccagacaaaugacagcaccauuaagcucaucgcuaugcuguauacaccccuucgcgccaacaacgccggcgaagaugucuucaccguuuccugcagagugcugacacggcccagcccugacuuugauuucauuuuucucgugccgcccaccgucgagucucgcacgaaaccuuucaccgugcccauccugacaguugaagagaugaccaauuccagauuuccuauuccccuugagaagcuguucacagggccgagcggagcuuucgugguccagccucagaacggccgguguaccacggacggggugcuccugggaacaacccaacugucucccguuaauaucugcacauuucgcggcgaugugacccauaucgcgggcuccagaaacuacaccaugaaucucgccagccugaacuggaauaacuaugacccuacagaagagauucccgcuccucuugggacgcccgauuucgucggaaaaauccagggcgugcugacccagacaaccaagggggacggaucuacacggggccacaaggccaccgucuacacgggguccgccccguuuacaccuaaacucggaagcgugcaguucuccaccgacaccgaaaaugauuuugagacacaucaaaacaccaaguucacacccguuggcgugauucaggacggcgggacgacccaccgcaaugaaccccagcaauggguccugccuucuuacagcggaagagaugugcacaacguucaucuugcuccggccguggcgcccacauuuccuggcgagcagcuccuguucuuucgguccaccaugcccggguguagcggauauccuaauauggaccuggauugccugcucccccaggaguggguccagcacuucuaccaagaagcugccccugcccagucugacguggcucugcuucgcuuugugaaccccgauacaggcagaguucuguucgaguguaaacuccauaaguccggguaugucaccguggcccacacgggccagcacgaccuggugaucccgccuaauggauacuuucgguucgauagcugggucaaccaguucuauacccuugcucccaugggcaacgggacaggaagacgccgguga

SEQ ID NO: 30044 - RNA, 1617 nt, Artificial Sequence
  derived and/or modified sequence opt5 from VP1__Norovirus_and/or_Norovirus-like__KF768522
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugauccauaucucuggcuccagaaacuacacaaugaaucucgccagccagaacuggaacuccuaugaucccaccgaggaaauuccugcuccccugggcaccccggacuucgucgggaaaauccagggagugcuuacacagacgacccggacaaauggcucuacccgcgggcacaaggcgacaguuuacaccggaagcgccgacuuuuccccuaagcugggcagagugcaauucgcuacggauacagacaaugauuuugagaccaaccagaauaccaaauucacacccgucggggugauucaggacggaagcaccacaccccggaacgaaccucaacaguggguucucccgucuuacuccggccgcaauauccauaacgugcaccuggcccccgccgucgcuccuacguuucccggcgagcagcuucuguucuuuagaagcaccaugccuggguguucuggauaucccaauauggaucucgacugccugcugccucaggaaugggugcaauacuucuaucaggaggccgcgcccgcucagagcgauguggcccuccugcgguuuguuaacccggacacaggcagaguccuuuucgaguguaagcugcacaaauccggguacgugaccguggcccauacaggacagcacgaucucgucauuccucccaacggcuauuuucgcuucgacucuugggugaaucaauucuacacccuggcuccuauggggaacggcacgggacggagacgcuga

SEQ ID NO: 30045 - RNA, 1617 nt, Artificial Sequence
  derived and/or modified sequence opt5 from VP1__Norovirus_and/or_Norovirus-like__KF060120
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggaacgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaacuccagauuucccaucccgcuugagaagcuguucaccgggccuagcucugccuucgugguucagccccagaauggaaaauguacaaccgauggcgugcuccuggggacgacacaacuguccccugucaacauuugcaccuuucggggagacgugacacauauccccggcagccgcaauuacaccaugaaccucgccucucagaauuggaacuccuaugauccuaccgaggaaauccccgcuccgcugggcacaccugacuucgucgggaagauucagggagugcuuacgcagaccacaagaaccaauggcagcacacgggggcacaaggcgaccguuuacacgggauccgccgacuuuucucccaaacugggccgcgugcaauucgcuacagauaccgacaacgauuuugagaccaaucagaacacaaaguucacccccgucggggugauccaggacggaagcacaacgccuagaaaugaaccgcaacaguggguucuccccuccuacagcggccggaacauucauaaugugcaccuggccccugccgucgcucccaccuuuccuggcgagcagcuucuguucuuucgcucuacaaugcccggguguuccggauauccuaacauggaucucgacugccugcugccccaggaaugggugcaauacuucuaucaggaggccgcgccggcucagagcgauguggcccuccugagauuuguuaacccugacaccggccggguccuuuucgaguguaaacugcacaagucuggguacgugacaguggcccauaccggacagcacgaucucgucauucccccuaauggcuauuuuagauucgacagcugggugaaccaauucuacacgcuggcucccauggggaauggcaccggacgccggagauga

SEQ ID NO: 30046 - RNA, 1617 nt, Artificial Sequence
  derived and/or modified sequence opt5 from VP1__Norovirus_and/or_Norovirus-like__KF060102
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggaaacgugacccauaucacaggcucuagaaauuacaccaugaaccucgcuucccagaauuggaacaauuaugaccccaccgaggaaauuccugcgccccugggcacaccggauuucguugggaaaauccagggagugcuuacgcagaccacacggaccgacggcagcacacgcgggcacaaggccaccgucuacaucggauccgcugacuuugccccuaagcugggcagagugcaauucgagacggauacagaccaugauuuugaagccaaccagaauaccaaauucacccccguuggggugauucaggacggaggcacaacccaccggaacgagccccaacaguggguccucccuucuuacagcggccgcaauacacacaacgugcaucuggcuccggccguggcgcccacguuuccuggggaacagcuucuguucuuuagauccaccaugcccggauguagcggcuauccuaauauggaucucgacugccugcugccccaggaguggguucaauacuucuaucaggaggcugccccugcccagucugaugucgcucuccugcgguuugugaaccccgacacagggagagugcuuuucgaauguaagcugcacaaauccggauacgucaccguggcccauacaggccagcacgaucucguuaucccgccuaacggguauuuucgcuucgacagcugggugaaucaauucuacacccuggcucccaugggcaacggaacgggccggagacgcuga

SEQ ID NO: 30047 - RNA, 1617 nt, Artificial Sequence
  derived and/or modified sequence opt5 from VP1__Norovirus_and/or_Norovirus-like__KF060088
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggaaugcuuacgcagaccacacggaccgacggcucuacacgcgggcacaaggcgaccguguacacgggaagcgccgauuuuuccccuaagcugggcagaguucaauucgcuacagacaccgauaaugacuuugugaccaaucagaacacaaaauucacccccgucggggugauccaggauggaagcacaacgccccggaaugagccucaacaguggguucucccgucuuacuccggccgcaacacccauaaugugcaccuggcccccgccgucgcuccuacauuucccggcgaacagcuucuguucuuuagaagcaccaugccuggguguucuggauaucccaacauggaccucgauugccugcugccucaggagugggugcaauacuucuaucaggaagccgcgcccgcucagagcgacguggcccuccugcgguuuguuaauccggauacaggcagaguccuuuucgaguguaagcugcacaaauccggguacgugaccguggcccauacgggacagcacgaccucgucauuccucccaacggcuauuuucgcuucgauucuugggugaaccaauucuacacccuggcuccuauggggaauggcacaggacggagacgcuga

SEQ ID NO: 30048 - RNA, 1617 nt, Artificial Sequence
  derived and/or modified sequence opt5 from VP1__Norovirus_and/or_Norovirus-like__KF060025
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucgccgaucagaauaccaaauucacacccguggggguuauccaggacggaagcaccacaccccggaacgagccucaacagugggugcucccgucuuacuccggccgcaauacgcauaacguccaccuggcccccgcuguggccccuaccuuucccggcgaacagcuucuguucuuuagaagcacaaugccuggguguucuggauaucccaauauggaucucgacugccugcugccucaggagugggugcaauacuucuaucaggaagcggcucccgcccagagcgauguugcccuccugcgguuugucaacccggacaccggcagagugcuuuucgaguguaagcugcacaaauccggguacgugacagucgcucauaccggacagcacgaucucgugauuccucccaauggcuauuuucgcuucgacucuuggguuaaccaauucuacacgcuggccccuauggggaacggcaccggacggagacgcuga

SEQ ID NO: 30049 - RNA, 1617 nt, Artificial Sequence
  derived and/or modified sequence opt5 from VP1__Norovirus_and/or_Norovirus-like__KC517378
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugggcaacaauuuuuaucacuacaaccagagcaaugaccccacaauuaagcucaucgccaugcuguauacaccccuucgggcuaacaacgccggggaugacguguucaccgucuccugccgcgugcugaccagaccuagcccggauuuugacuucauuuuucucguucccccuacaguggaaucucggaccaaacccuucuccgucccugugcugacgguugaggaaaugaccaauagccgcuuucccaucccgcuugagaagcuguucacaggaccuucuuccgccuucgugguccagccccagaacggcagauguaccacagauggggugcuccugggaaccacgcaacugagcccugucaauauuugcacauuucggggcgacgugacccauaucacaggcucucgcaacuacaccaugaaucucgcuucccagaacuggaauaacuaugaucccaccgaggaaauuccugcgccccuggggacaccggacuucguuggaaaaauccagggcgugcuuacgcagaccacaagaaccgacgggagcacacggggacacaaggccaccgucuacacgggcuccgcugauuuugccccuaagcuggggcgcgugcaauucgagacagacaccgaucaugacuuugaagccaaucagaacaccaaauucacacccguuggagugauccaggauggcggcaccacacacagaaaugagccccaacaguggguccucccuucuuacagcgggcggaacacgcacaaugugcaucuggcuccggccguggcgcccaccuuuccuggagaacagcuucuguucuuucgcuccacaaugcccggcuguagcggguauccuaacauggaccucgauugccugcugccccaggaguggguucaauacuucuaucaggaggcugccccugcccagucugacgucgcucuccugagauuugugaaucccgauaccggacgggugcuuuucgaauguaagcugcacaaauccggcuacgucacaguggcccauaccgggcagcacgaccucguuauuccgccuaacggcuauuuuagauucgauagcugggugaaccaauucuacacgcuggcucccaugggaaauggcaccgggcgccggagauga

SEQ ID NO: 30050 - RNA, 1617 nt, Artificial Sequence
  derived and/or modified sequence opt5 from VP1__Norovirus_and/or_Norovirus-like__JX459640
augaagauggccagcuccgacgcuaaccccucugauggcagcaccgcccaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucauugucgacgugagacaacucgagccugugcugaucccccugccugauguccggaauaacuuuuaucauuacaaucagagcaacgaccccaccauuaagcucaucgcuaugcuguauacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacacauccccggcucuagaaauuacaccaugaaccucgccucccagaauuggaacagcuaugauccuaccgaggaaauccccgcuccgcugggcacaccugacuucgucgggaaaauucagggagugcuuacgcagaccacacggaccaauggcuccacacgcgggcauaaggcgaccguuuacacgggaucugccgacuuuagccccaagcugggcagagugcaauucgcuacagauaccgacaacgauuuugagaccaaucagaacacaaaauucacccccgucggggugauccaggacggauccacaacgccucggaaugaaccgcaacaguggguucuccccagcuacucuggccgcaacauucacaaugugcaccuggccccugccgucgcucccaccuuuccuggcgagcagcuucuguucuuuagauccacaaugcccggguguagcggauauccuaacauggaucucgacugccugcugccccaggaaugggugcaauacuucuaucaggaggccgcgccggcucagucugauguggcccuccugcgguuuguuaauccugacaccggcagaguccuuuucgaguguaagcugcauaaaagcggguacgugacaguggcccacaccggacagcaugaucucgucauucccccuaacggcuauuuucgcuucgacuccugggugaaccaauucuacacgcuggcucccauggggaauggcaccggacggagacgcuga

SEQ ID NO: 30051 - RNA, 1617 nt, Artificial Sequence
  derived and/or modified sequence opt5 from VP1__Norovirus_and/or_Norovirus-like__JQ613512
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaagauguuuucaccgugagcugcagagugcugacacggcccucuccugacuuugauuucauuuuucucgucccgcccaccguggagucccgcacgaaaccuuucaccguucccauccugacaguggaagagaugaccaauagcagauuuccuauuccccuugagaagcuguucacagggccgucuggagccuucgucgugcagccucagaacggccgguguaccacggacgggguucuccugggaacaacccaacugucccccgugaauaucugcacauuucgcggcgaugucacccauaucgccggcagcagaaacuacaccaugaaucucgcuucucugaacuggaauaacuaugacccuacagaagagauucccgcgccucuugggacgcccgauuucgugggaaaaauccagggcguccugacccagacaaccaagggggacggauccacacggggccacaaggccaccguguacacggggagcgcuccguuuacaccuaaacucggauccguucaguucucuaccgacaccgaaaaugauuuugagacacaucaaaacaccaaguucacacccgugggcgucauucaggacggcagcacgacccaccgcaaugaaccccagcaaugggugcugccuuccuacagcgggagaaacguucacaaugugcaucuugccccggccgucgcucccacauuuccuggagagcagcuccuguucuuucggucuaccaugcccggcuguuccggguauccuaacauggaucuggacugccugcucccccaggagugggugcagcacuucuaccaagaagccgcgccugcucagagcgauguggcccugcuucgcuuuguuaaucccgacacaggaagaguccuguucgaguguaaacuccauaagucuggcuaugugaccguggcccacacggggcagcacgaucuggucaucccgccuaacggcuacuuucgguucgacgcuugggugaaccaguucuauacccuugcccccaugggaaauggcacagggagaaaacgcuga

SEQ ID NO: 30052 - RNA, 1617 nt, Artificial Sequence
  derived and/or modified sequence opt5 from VP1__Norovirus_and/or_Norovirus-like__HQ005299
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccugucccgcauguauaauggguacgccggaggcuucgaaguccaggugauccuugcuggcaacgccuuuacggcugggaaaauuaucuucgccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccgggccuuccagcgcuuucgugguucagccccagaacggacgguguacaaccgauggcgugcuccuggggacgacacaacugucuccugucaauauuugcaccuuucgcggagacgugacacauauccccggcuccagaaacuacaccaugaaucucgccagccagaacuggaacuccuaugauccuaccgaggaaauccccgccccgcugggcacaccugacuucgucgggaaaauucagggagugcuuacgcagaccacacggaccaauggcucuacacgcgggcacaaggcuaccguuuacacgggaagcgcggacuuuucccccaagcugggcagagugcaauucgccacagauaccgacaaugauuuugagaccaaccagaauacaaaauucacccccgucggggugauccaggacggaagcacaacgccucggaacgaaccgcaacaguggguucuccccucuuacuccggccgcaauauucauaacgugcaccuggcuccugccgucgcccccaccuuuccuggcgagcagcuucuguucuuuagaagcacaaugcccggguguucuggauauccuaauauggaucucgacugccugcugccccaggaaugggugcaauacuucuaucaggaggcugccccggcgcagagcgauguggcucuccugcgguuuguuaacccugacaccggcagaguccuuuucgaguguaagcugcacaaauccggguacgugacaguggcccauaccggacagcacgaucucgucauucccccuaacggcuauuuucgcuucgacucuugggugaaucaauucuacacgcuggcccccauggggaacggcaccggacggagacgcuga

SEQ ID NO: 30053 - RNA, 1617 nt, Artificial Sequence
  derived and/or modified sequence opt5 from VP1__Norovirus_and/or_Norovirus-like__AB541312
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuguauucucgaucugcccccuaccgucgaaucucgcacgaaacccuucuccgugccuauccuuaccguugaggaaaugacaaauagcagauuucccauuccgcuggagaagcuguucaccgggccuucuuccgccuuugugguccagccccagaacggacggugcacaaccgacggcgugcugcuggggacgacacaacucagcccuguuaauaucuguaccuuccgcggagaugugacacauaucaccggcucuagaaacuacaccaugaaucuggccacacagaacuggaacuccuaugaccccacggaggaaauuccugcuccccuuggcaccccggacuucgucgggaaaauccagggagugcugacacagaccacacgggcggauggcagcacccgcgggcacaaggccacggucuacacaggauccgcugacuuugccccuaagcucggcagagugcaauucgccaccgauaccgacaaugauuuugacgcuaaucagaacacaaaauucacccccguuggggugauucaggauggagacacagcccaucggaaugagccccaacaguggguccugccuucuuacagcggccgcaacucccacaaugugcaccuugcgccggcuguugcccccacguuuccuggcgaacagcuccucuucuuuagaagcaccaugcccgggugcucuggauauccuaacauggaucuggacugucugcucccccaggagugggugcaauacuucuaucaggaagccgcuccugcccaguccgaugucgcucugcuucgguuugugaaucccgacacaggcagagugcuguucgagugcaagcuccauaaaagcggguacguuaccgucgcccacacaggacagcaugaccuggugaucccgccuaacggcuauuuucgcuucgauucuugggugaaccaauuuuacacccuugcgcccauggggaauggcacgggacggagacgcuga

SEQ ID NO: 30054 - RNA, 1617 nt, Artificial Sequence
  derived and/or modified sequence opt5 from VP1__Norovirus_and/or_Norovirus-like__AB541275
augaagauggccagcuccgacgcuaaucccccugauggcucugccgcgaaccuggugccggaggucaacaaugaaguuauggcucucgagcccguggugggggccgccaucgcugccccugucgcuggacagcaaaacgugauugaccccuggaucagaaauaacuucguucaggccccuggcggggaauuuaccgugagcccccggaaugcgccuggagagauucugugguccgccccgcuuggccccgaucugaacccuuaccucucucaccuggcucgcauguauaauggguacgccggaggcuucgaaguccaggugauccuugcuggcaacgccuuuacagcggggaaaauuaucuucgccgcuguucccccuaauuuucccacggagggacugagcccgucccaggugaccauguucccucauaucauugucgacgugagacaacucgagcccgugcugaucccucugcccgauguccggaacaauuuuuaucacuacaaccagucuaaugacagcacaauuaagcucaucgccaugcuguauacaccccuucgcgcuaacaacgccggcgaagauguuuucaccguguccugcagagugcugacccggccuagcccggacuuugauuucauuuuucucgugcccccuacagucgagucucgcaccaaacccuucacgguuccuauccugaccguggaagagaugacaaauuccagauuucccauuccgcuugagaagcuguucaccgggccuagcggagccuucgucgugcagccccagaacggccgguguacaaccgacgggguucuccugggaacgacacaacugucuccugugaauaucugcaccuuucgcggcgaugucacacauaucgcuggcuccagaagcuacaccaugaaccucgcgucucugaauuggaacaauuaugaccccaccgaagagauuccugcuccccuugggacaccggauuucgugggaaaaauccagggcaugcugacgcagaccacaaagggggacggauccacccggggccacaaggccacagucuacaccgggagcgccccuuuuacgcccaaacucggauccgugcaguucucuacagacaccgaaaacgauuuucaaacccaucagaauacaaaguucacccccguuggcgugauucaggacggcagcacaacgcaccgcaacgagccucaacaguggguccugccguccuacagcgggagagaugugcacaauguucaucuugcccccgcuguggccccuaccuuucccggagaacagcuccuguucuuucggucuacaaugccuggcuguuccggguaucccaacauggaccuggauugccugcucccucaggaguggguccaacacuucuaccaggaggcggcucccgcccagagcgacguggcccugcuucgcuuugugaauccggauaccggaagaguucuguucgaauguaaacuccauaagucuggcuaugucacaguggcucacaccgggcagcacgaccuggugaucccucccaacggcuacuuucgguucgauagcugggucaaucaauucuauacgcuugccccuaugggaaacggcaccgggagacgccgguga

SEQ ID NO: 30055 - RNA, 1617 nt, Artificial Sequence
  derived and/or modified sequence opt5 from VP1__Norovirus_and/or_Norovirus-like__AB303930
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugguucuugccggcaacgcuuuuaccgccgggaaaaucauuuucgcggccgugccucccaauuuuccuacagagggacugagccccucccaggucaccauguucccgcauaucaucguggacgugagacaacucgagccuguccugauuccccugccugauguucggaacaaucucuaucacuacaaccagucuaaugaccccacaaucaagcugauugcuaugcuuuauacaccccugcgcgccaacaacgcuggcgaagauguguuuaccgugagcugcagaguccucacccggccuuccccggacuucgauuuuaucuuccuggugcccccuacgguugagagccgcaccaaacccuuuacagugccuauucuuaccggggaagagaugacaaauucuagauuccccaucccgcuggagaagcucuuuaccggaccuuccggcgccuucgucgugcagccccagaacgggcgguguacgacagacggaguucugcugggcaccacacaacuccugccugugaauauuugcaccuuccgcggcgaugucacccauaucgccgggacacacaacuacacgaugaaucuugcuagccagaacuggaauaacuaugaccccaccgaagagaucccugcgccccugggaacaccggauuuugugggccggauucaggggaugcucacccagacaaccagaggagacggcucuacgcgcgggcauaaagccacagucuccaccggagacgugcacuucaccccuaagcugggcagcauccaauuuaauacagauaccaacaaugacuucgaaacaggccagaacacgaaguuuacccccguuggggugguccaggauggaaauggcacacaccaaaacgagccccagcagugggugcuuccuucuuacuccgggagaaccagccauaauguucaccuggcuccggccguggcccccacauucccuggagaacagcuccuguuuuuccgguccaccaugcccggcuguucuggguacccuaacaugaaccuggacugccuccugccccaagaguggguccagcauuuuuaucaggaggcugccccugcgcagagcgauguggcccuucugcgcuucgugaaucccgacacgggcagaguucucuuugaauguaaacugcacaaguccggauacgucaccguggcucacacaggccaacaugaucuugugauuccgccuaacggguauuuccgguuugacagcugggucaaucaguucuacacccuggcccccaugggaaacggcacagggagacgccgguga

SEQ ID NO: 30056 - RNA, 1617 nt, Artificial Sequence
  derived and/or modified sequence opt5 from VP1__Norovirus_and/or_Norovirus-like__AY485642
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucccucaccuggcccgcauguauaacggguacgcuggaggcuucgaaguccaggugauccuugccggcaaugcuuuuacggccgggaaaauuaucuucgcggccguucccccuaacuuucccaccgagggacugucuccgagccaggugacaauguucccucauaucauugucgacgugagacaacucgagcccgugcugaucccucugcccgauguccggaauaacuuuuaucacuacaaucaguccaacgaccccaccauuaagcucaucgcuaugcuguauacaccucuucgcgccaacaaugcuggcgaagauguuuucaccgugucuugcagagugcugacacggccgagccccgacuuugauuucauuuuucucgucccucccaccguggagucccgcacgaaaccuuucaccguucccauccugacaguggaagagaugaccaacagcagauuuccgauuccucuugagaagcuguucacagggcccucuggagccuucgucgugcagccucagaauggccgguguaccacggacgggguucuccugggaacaacccaacugucccccgugaacaucugcacauuucgcggcgaugucacccauaucgccggcacccacaauuacacaaugaaccucgcuagccagaauuggaacaauuaugggccuacggaagagauucccgcgccgcugggaaccccugacuucgugggcagaauccaggggaugcuuacacagaccacacggggagauggcucuacccgcgggcauaaagccacggucuccacaggagacgugcacuuuacccccaagcugggcagcauucaauucaacaccgacacaaauaacgauuuugaaaccggccagaauacaaaguucacgcccguuggggugguccaggacggaaacggcacccaccaaaaugagccucagcagugggugcucccgucuuacuccgggagaacaggacauaacguucaccuggcucccgccguggccccuaccuuucccggcgaacagcuucuguucuuucggagcacaaugccuggguguuccggcuaccccaacaugaaucucgauugccugcugccucaagaguggguccagcauuucuaucaggaggcugcccccgcgcagucugacguggcucuccugcgcuuugugaacccggauaccggaagaguucuuuucgaauguaaacugcacaagagcggcuacgucacgguggcccacaccgggcaacaugaccucgugaucccucccaauggauauuuucgguucgauuccugggucaaccaguucuacacacuggccccuaugggcaaugggaccggaagacgccgguga

SEQ ID NO: 30057 - RNA, 1617 nt, Artificial Sequence
  derived and/or modified sequence opt5 from VP1__Norovirus_and/or_Norovirus-like__KX514343
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcaccaacaaugcuggcgaugacguuuucaccguguccugcagagugcugacacggcccagcccugauuuugacuucauuuuucucgucccgcccaccguggaaucucgcuccaaaccuuucagcguucccgugcugacggucgaggaaaugaccaacucuagauuuccugccacacuugauaagcuguucaccgggcccuccagcacauucgugguucagccgcagaauggacgguguaugaucgacggcgugcuccuggggaccacgcaacugucuccugucaacauuugcacauuucgcggagaugugacccaguccggcaauacaaaaaucuacaccaugaaccucgccagccccaauuggaacaauuaugacccuaccgaggagauccccgcuccucugggcacacccgacuucgucgggaagauucagggaaugcuuacgcagaccacaaagggcgaaggguccaccagaggacaucgggcgacaguguacguuggcucugccaacuacgcuccgaaacuggggcgcgugcaauuugagaccgauacgacagacgaucucgacgcccaccagaauaccaaguucaccccugucggagugguucagagcggcgaaucccccaaaggcagcgagccccaacagugggugcugccuucuuauuccgggagagauacaccgaacguccaucuugcccccgcuguggccccuaccuuucccggagaacagcuccuguucuuucggagcacaaucccuggcugugggggacaccccaauaugaaccuggacugccugcucccucaggagugggugcaacacuucuaccaggaggcggcucccgcccagucugauguugcccugcuucgcuuugucaauccggacacgagcagagugcuguucgaauguaagcuccauaaauccggcuaugugaccgucgcucacacagggcaguacgaucuggugcuuccuucuaacggcuauuuucgguucgacagcuggguuaaccaauuuuacacccuggcccccaugggaaauggcacagggagacgccgguga

SEQ ID NO: 30058 - RNA, 1617 nt, Artificial Sequence
  derived and/or modified sequence opt5 from VP1__Norovirus_and/or_Norovirus-like__KX514274
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaaggacagcacaauuaaacucaucgccaugcuguauacgccccuucgcgcuaacaacgccggcgaugacguuuucacaguguccugcagagugcugacccggcccagcccugauuuugacuucauuuuucucgucccgcccacaguggaaucucgcuccaagccuuucagcguucccgugcugaccgucgaggaaaugaccaauucuagauuuccugugacccuugauaaacuguucacagggcccuccagcaccaucguugugcagccgcagaacggacgguguacaauugacggcguccuccuggggaccacgcaacugucuccugugaauaucugcacauuccgcggagaugucacccaucccagagacuccacaaucuacaccaugaaccucgccagcccuaauuggaacaccuaugaccccacagaggagauuccugcuccccugggcacgccggauuuugugggcaagauccaggggaugcuuacccagacaaccaagggagcgggcuccacacgggggcaccgcgccaccguuuacgugggaucugcuaauuacgccccuaaacugggcagaguccaguucgaaacgaacacaagcgacgaucucgacgcccaucaaaauaccaaguuuacccccguggggguuauucagggaggcgaguccgcucaccggagcgaaccccagcaaugggugcugccuucuuauuccggccgcgauaucccgaacguccaccuugcccccgcgguggcuccuacauuccccggggagcagcugcucuuuuucagaagcaccauuccuggauguggcgggcaucccaauauggaccuggauugccugcucccucaggaaugggugcagcacuuuuaccaagaggccgcccccgcucagucugacguugcccugcuucgguucgucaacccggauacaagcagagugcuguuugaguguaaacuccauaaguccggauaugugacggucgcucacaccggccagcacgaccuggugaucccucccaauggguacuuccgcuuugauucuuggguuaaccaguucuauacacuugccccuaugggcaauggaaccggccggaaaagauga

SEQ ID NO: 30059 - RNA, 1617 nt, Artificial Sequence
  derived and/or modified sequence opt5 from VP1__Norovirus_and/or_Norovirus-like__KX514175
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccaaaaucuacaccaugaaucucgcuagcccuaacuggaauaacuaugaccccacagaggagaucccugcgccccugggcaccccggauuucgucggcaagauucaggggaugcuuacccagacaacgaagggagaaggcuccacccgggggcaccgcgccacaguguacguuggaucugcuaauuacgccccuaaacugggcagagugcaguuugagaccgacacaaccgaugaccucgaugcccaucaaaacacgaaguucacacccgucggggugguucagggaggcgaaagccccaaaggcuccgagccucagcaaugggugcugccgagcuauucuggggcuaauaccuuuaacguccaccuugcccccgcgguggcuccuaauuuccccggagaacagcugcucuuuuuccgguccacccugccuggcugugggggacaccccaacauggaccuggauugccuccugccucaggagugggugcagcauuuuuaccaagaggccgcccccgcucagagcgacguugcccuucugcgcuucgucaauccggauacaucuagagugcucuuugaauguaagcugcacaaaagcggcuaugugaccgucgcucauacagggcagcacgaccuugugaucccucccaacggcuacuuccgguuugauuccuggguuaaccaguucuauacgcuggccccuaugggaaauggcaccgggagaaagcgcuga

SEQ ID NO: 30060 - RNA, 1617 nt, Artificial Sequence
  derived and/or modified sequence opt5 from VP1__Norovirus_and/or_Norovirus-like__KX354093
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacugguccucuuaugaucccaccgaggaaauuccugcuccccugggcacaccggacuucguggggaaaauccagggaguccuuacgcagaccacaagcaccaauggcuccacaagagggcauaaggcgaccguguacacgggaagcgccgacuuuucuccuaagcugggccggguucaauucgcuacagauaccaacaaugacuuugagaccaaccagaauacaaaauucacccccgugggggucauucaggauggauccacaacgccccgcaacgaaccucaacagugggugcucccgagcuacucuggcagaaauauccacaacguucaccuggcccccgccguggcuccuaccuuucccggcgagcagcuucuguucuuucggagcacaaugccuggguguuccggauaucccaauauggaccucgauugccugcugccucaggaauggguccaauacuucuaucaggaggccgcgcccgcucagucugacguggcccuccugcgcuuugugaacccggauaccggcagaguucuuuucgaguguaagcugcauaaaagcggguacgucacaguggcccacaccggacagcaugaccucgugauuccucccaacggcuauuuucgguucgauuccugggucaaucaauucuacacgcuggcuccuauggggaacggcaccggaagacgccgguga

SEQ ID NO: 30061 - RNA, 1617 nt, Artificial Sequence
  derived and/or modified sequence opt5 from VP1__Norovirus_and/or_Norovirus-like__KX354003
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauacccauaacgugcaccuggcccccgccgucgcuccuacauuucccggcgagcagcuucuguucuuuagaagcaccaugccuggguguucuggauaucccaauauggaucucgacugccugcugccucaggaaugggugcaauacuucuaucaggaggccgcgcccgcucagagcgauguggcccuccugcgguuuguuaacccggacacaggcagaguccuuuucgaguguaagcugcacaaauccggguacgugaccguggcccauacgggacagcacgaucucgucauuccucccaacggcuauuuucgcuucgacucuugggugaaucaauucuacacccuggcuccuauggggaacggcacaggacggagacgcuga

SEQ ID NO: 30062 - RNA, 1617 nt, Artificial Sequence
  derived and/or modified sequence opt5 from VP1__Norovirus_and/or_Norovirus-like__KR131778
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucaccgaucagaauacaaaauucacccccguggggguuauccaggacggaagcacaacgccccggaacgagccucaacagugggugcucccgucuuacuccggccgcaauacccauaacguccaccuggcccccgccguggcuccuacauuucccggcgaacagcuucuguucuuuagaagcaccaugccuggguguucuggauaucccaauauggaucucgacugccugcugccucaggagugggugcaauacuucuaucaggaagccgcgcccgcucagagcgauguugcccuccugcgguuugucaacccggacacaggcagagugcuuuucgaguguaagcugcacaaauccggguacgugaccgucgcccauacgggacagcacgaucucgugauuccucccaauggcuauuuucgcuucgacucuuggguuaaccaauucuacacccuggcuccuauggggaacggcacaggacggagacgcuga

SEQ ID NO: 30063 - RNA, 1617 nt, Artificial Sequence
  derived and/or modified sequence opt5 from VP1__Norovirus_and/or_Norovirus-like__AB972468
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuaucccccuugagaagcuguucacagggccguccagcgccuucgugguccagccucagaacggacgguguaccacagauggcgugcuccuggggaccacgcaacugucucccgucaauauuugcacauuucgcggagacgugacccauaucacaggcuccagaaacuacaccaugaaucucgcuagccagaacugguccaauuaugauccuaccgaggaaauucccgcgccucugggcacacccgacuucguugggaaaauccagggagugcuuacgcagaccacacggaccgacggcucuacacgcgggcacaaggccaccgucuacacgggaagcgcugauuuugugccgaagcugggcagaguucaauucgagacagacaccgaucgggacuuugaagccaaccagaauaccaaauucacaccugugggggucauccaggauggauccaccacacaucgcaacgagccccaacagugggugcuccccagcuacucuggcagaaauacgccuaacgugcaccuggccccggcuguugcccccaccuuuccuggcgaacagcuucuguucuuucgguccacaaugcccggguguagcggauauccuaauauggaccucgauugccugcugccccaggaguggguccaauacuucuaucaggaggcggcuccugcccagucugacguggcccuccugagauuugugaaccccgauaccggccgcguccuuuucgaauguaagcugcacaaaagcggguacgugacaguugcucauaccggacagcacgaccucgugauuccgccuaauggcuauuuucgguucgauuccugggucaaccaauucuacacgcuggcccccauggggaacggcaccggaagacgccgguga

SEQ ID NO: 30064 - RNA, 1617 nt, Artificial Sequence
  derived and/or modified sequence opt5 from VP1__Norovirus_and/or_Norovirus-like__KR904222
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacugugauccuaccgaggaaauccccgcgccucugggcacacccgacuucgucgggaaaauucagggaaugcuuacgcagaccacacggaccgacggcuccacacgcgggcacaaggccaccguguauacgggaucugcugauuuugccccgaagcugggcagaguucaauucgagacagacaccgaucaugacuuugaagccaaucagaacaccaaauucacaccugugggggucauccaggauggaagcaccacacaccggaaugagccccaacagugggugcuccccuccuacagcggccgcaacacgcacaauguucaucuggcuccugccguggcgccgaccuuucccggcgaacagcuucuguucuuuagaucuacaaugccugggugcuccggauaccccaacauggaccucgauugucugcugccucaggaguggguccaauauuucuaccaggaggcugcccccgcccagagcgacguggcucuccugcgguuugugaauccugauaccggcagaguucuuuucgaaugcaagcugcacaaaucuggguaugucacaguggcccauaccggacagcacgaccucgugauucccccgaacggcuacuuucgcuucgauagcugggucaaccaauucuauacgcuggcuccuauggggaauggcaccggacggagacgcuga

SEQ ID NO: 30065 - RNA, 1617 nt, Artificial Sequence
  derived and/or modified sequence opt5 from VP1__Norovirus_and/or_Norovirus-like__KP244320
augaagauggccagcuccgacgcuaaccccucugauggcagcaccgccaaucuggugccugaggucaacaaugaaguuauggcgcucgagccgguggugggggcuuccaucgccgcccccgucgcuggacagcaaaacgugauugacccuuggaucagaaauaacuucguucaggcccccggcggggaauuuacagugucuccucggaaugcucccggagagauucuguggagcgccccucuuggcccggaucugaaccccuaccucccucaccuggcgcgcauguauaauggguacgccggaggcuucgaaguccaggugauccuugcuggcaacgccuuuacggcugggaaaauuaucuucgccgcgguucccccuaauuuucccaccgagggacuguccccgucucaggugacaauguucccucauaucauugucgacgugagacaacucgagcccgugcugaucccucugcccgauguccggaacaauuuuuaucacuacuaucagagcaacgaccccaccauuaagcucaucgccaugcuguacacaccucuucgcgcuaauaacgccggcgaugacguuuucaccguguccugcagagugcugacacggccgagccccgauuuugacuucauuuuucucgucccucccaccguggaaucucgcacgaaaccuuucuccguucccgugcugaccgucgaggaaaugacaaacagcagauuuccgaucccucuugagaagcuguucaccgggcccucuuccgcuuucgugguucagccucagaauggacgguguacaaccgauggcgugcuccuggggacgacacaacugagccccgucaacauuugcaccuuucgcggagacgugacacauaucucuggcuccagaaauuauaccaugaaccucgccagccagaauuggaacuccuacgauccuaccgaggaaauccccgccccgcugggcacaccugacuucgucgggaaaauucagggagugcuuacgcagaccacacggaccaauggcucuacacgcgggcacaaggcuaccguuuacacgggaagcgcggacuuuucccccaagcugggcagagugcaauucgccacagauaccgacaacgauuuugagaccaaucagaacacaaaauucacccccgucggggugauccaggacggaagcacaacgccucggaaugaaucucaacaguggguucucccguccuauagcggccgcaacacccauaaugugcaccuggcucccgccgucgccccuacauuucccggcgagcagcuucuguucuuuagaucuaccaugccuggguguagcggauaccccaacauggaucucgacugccugcugccucaggaaugggugcaauauuucuaccaggaggcugcccccgcgcaguccgauguggcucuccugcgguuuguuaauccggacacaggcagaguccuuuucgaguguaagcugcacaaaucuggguaugugaccguggcccauacgggacagcacgaucucgucauuccucccaacggcuacuuucgcuucgacagcugggugaaccaauucuauacccuggccccuauggggaauggcacaggacggagacgcuga

SEQ ID NO: 30066 - RNA, 1617 nt, Artificial Sequence
  derived and/or modified sequence opt5 from VP1__Norovirus_and/or_Norovirus-like__KP244315
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgucgugcagguuauccuugccggcaaugcuuuuacggccgggaaaauuaucuucgcggccgugccucccaacuuuccuaccgaaggacugucucccagccaggucacaauguucccgcauaucauuguggacgcuagacaacucgagccugugcugaucccccugccugauguccggaauaacuuuuaucacuacaaucaguccaacgaccccaccauuaagcucaucgccaugcuguauacaccccuucgcgcuaauaacgccggcgaugacguuuucaccgugagcugcagagugcugacacggccuucuccggauuuugacuucauuuuucucgugcccccuaccgucgagucccgcacgaaacccuucagcguuccugugcugaccgucgaagagaugacaaacucuagauuucccaucccgcuugaaaagcuguucaccgggccuuccagcgccuucgugguucagccccagaauggacgguguacaaccgauggcgugcuccuggggacgacacaacugucuccugucaacauuugcaccuuucgcggagacgugacacauaucuccggcagcagaaauuacaccaugaaccucgcuucccagaauuggaacucuuaugaucccaccgaggagaucccugcgccccugggcacaccggacuucgucgggaaaauucagggagugcuuacgcagaccacaaagaccgacggcagcacacgggggcacaaggccaccguuuacacgggauccgcugauuuuagcccuaaacugggccgcgugcaauucgccacagacaccgauaaugacuuugaaaccaaccagaauacaaaguucacccccgucggggugauccaggauggaucuacaacgcccagaaacgagccucaacaguggguucucccguccuacagcggccggaauacccauaacgugcaccuggcccccgcugucgccccuacauuucccggcgaacagcuucuguucuuucgcucuaccaugccuggguguagcggauaucccaauauggaccucgauugccugcugccucaggagugggugcaauacuucuaucaggaagcggcucccgcccaguccgacguggcccuccugagauuuguuaacccggauacaggccggguccuuuucgaguguaaacugcacaagucuggguacgugaccguggcucauacgggacagcacgaccucgucauuccucccaauggcuauuuuagauucgauagcugggugaaccaauucuacacccuggccccuauggggaacggcacaggacgccggagauga

SEQ ID NO: 30067 - RNA, 1617 nt, Artificial Sequence
  derived and/or modified sequence opt5 from VP1__Norovirus_and/or_Norovirus-like__KP244314
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgucggaggcuucgaagugcagguuauccuugcuggcaacgccuuuacggcugggaaaauuaucuucgccgcggugccucccaauuuuccuaccgagggacugucccccucucaggucacaauguucccgcauaucauuguggacgugagacaacucgagccuguccugaucccccugccugauguucggaacaauuuucaccauuauaaccagagcaaugaccccaccauuaagcucaucgccaugcuguacacaccccuucgcgcuaacaacgccggcgaugacguguucaccguguccugcagaguccugacacggccuagcccggauuuugacuucauuuuucucgugcccccuaccguugaaucucgcacgaaacccuucuccgugccuguccugaccguggaggaaaugacaaauagcagauuucccaucccgcuugagaagcuguucaccgggccuucuuccgcuuucguugugcagccccagaacggacgguguacaaccgauggcguccuccuggggacgacacaacugagcccugugaauauuugcaccuuucgcggagacgucacacacauccccggcucuagaaacuauaccaugaaucucgccucccagaacuggaauagcuacgauccuaccgaggaaauccccgccccgcugggcacaccugacuucguggggaaaauucagggaguucuuacgcagaccacacggaccaacggcuccacacgcgggcauaaggcuaccguguauacgggaucugcggacuuuagccccaagcugggcagaauccaauucgccacagauaccgacaaugauuuugagaccaaccagaauacaaaauucacccccgucggggugauucaggacggauccacaacgccucggaacgaaccgcaacaguggguucuccccagcuacucuggccgcaauacccacaacgugcaccuggcuccugccgucgcccccacauuuccuggcgagcagcuucuguucuuuagauccaccaugcccggguguagcggauacccuaauauggaucucgacugccugcugccccaggaaugggugcaauauuucuaccaggaggcugccccggcgcagucugauguggcucuccugcgguuuguuaacccugacacaggcagaguccuuuucgaguguaagcugcauaaaagcggguaugugaccguggcccacacgggacagcaugaucucgucauucccccuaacggcuacuuucgcuucgacuccugggugaaucaauucuauacccuggcccccauggggaacggcacaggacggagacgcuga

SEQ ID NO: 30068 - RNA, 1617 nt, Artificial Sequence
  derived and/or modified sequence opt5 from VP1__Norovirus_and/or_Norovirus-like__KM268078
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuaucccccuugagaagcuguucacagggccguccagcgccuucgugguccagccucagaacggacgguguaccacagauggcgugcuccuggggaccacgcaacugucucccgucaauauuugcacauuucgcggagacgugacccauaucacaggcuccagaaacuacaccaugaaucucgcuagccagaacugguccaauuaugauccuaccgaggaaauucccgcgccucugggcacacccgacuucguugggaaaauccagggagugcuuacgcagaccacacggaccgacggcucuacacgcgggcacaaggccaccgucuacacgggaagcgcugauuuugccccgaagcugggcagagugcaauucgagacagacaccgaucaugacuuugaagccaaccagaauaccaaauucacaccuguuggggugauccaggauggaggcaccacacaccggaacgagccccaacaguggguccuccccuccuacagcggccgcaauacgccuaacgugcaccuggcuccggccguggcgcccaccuuuccuggggaacagcuucuguucuuuagaucuacaaugcccggauguuccggcuauccuaauauggaccucgauugccugcugccccaggaguggguucaauacuucuaucaggaggcugccccugcccagagcgacgucgcucuccugcgguuugugaaccccgauaccgggagagugcuuuucgaauguaagcugcauaaaucuggauacgucacaguggcccacaccggccagcaugaccucguuauuccgccuaauggguauuuucgcuucgauagcugggugaaccaauucuacacgcuggcucccaugggcaacggaaccggccggagacgcuga

SEQ ID NO: 30069 - RNA, 1617 nt, Artificial Sequence
  derived and/or modified sequence opt5 from VP1__Norovirus_and/or_Norovirus-like__KM198555
augaagauggccagcuccgacgcuaaccccucugauggcagcaccgccucccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugguucuugccggcaaugcuuuuacggccgggaaaaucauuuucgcggccgugccucccaacuuuccuaccgagggacugucucccagccaggucacaauguucccgcauaucaucguggacgugagacaacucgagccuguccugauuccccugccugauguucggaauaacuuuuaucacuacaaucaguccaacgaccccaccaucaagcucauugcuaugcuguauacaccccuucgcgccaauaacgcuggcgaugacguguucaccgugagcugcagaguccugacacggccuucuccggauuuugacuucaucuuucucgugcccccuaccguugaaucccgcacgaaacccuucagcgugccuguccugaccguggaggaaaugacaaacucuagauuucccauuccgcuugagaagcuguucaccgggccuuccagcgccuucguugugcagccccagaauggacgguguacaaccgauggcguccuccuggggacgacacaacugucuccugugaacaucugcaccuuucgcggagacgucacacauauuuccggcagcagaaauuacaccaugaaccucgccucccagucuuggaauagcuaugaucccaccgaggaaaucccugcuccccugggcuccccggacuucguggggaaaauccagggaguucuuacacagacgacccggacaaacggcagcacccgcgggcacaaggcgacaguguacaccggaucugccgacuuuuccccuaagcugggcagaguccaauucgcuacggauacagacaaugauuuugagaccaaccagaauaccaaauucacacccguggggguuauucaggacggaagcaccacaccccggaacgaaccucaacagugggugcucccgucuuacagcggccgcaauauccauaacguccaccuggcccccgccguggcuccuacguuucccggcgagcagcuucuguucuuuagauccaccaugccuggguguucuggauaucccaauauggaucucgacugccugcugccucaggaaugggugcaauacuucuaucaggaggccgcgcccgcucagagcgauguugcccuccugcgguuugucaacccggacacaggcagagugcuuuucgaguguaagcugcacaaauccggguacgugaccgucgcccauacaggacagcacgaucucgugauuccucccaauggcuauuuucgcuucgacagcuggguuaaccaauucuacacccuggcuccuauggggaacggcacgggacggagacgcuga

SEQ ID NO: 30070 - RNA, 1617 nt, Artificial Sequence
  derived and/or modified sequence opt5 from VP1__Norovirus_and/or_Norovirus-like__KF060115
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaacccggguacgugacaguggcccauaccggacagcacgaucucgucaucccucccaacggcuauuuucgcuucgacagcugggugaaucaauucuacacgcuggcuccgauggggaacggcaccggacggagacgcuga

SEQ ID NO: 30071 - RNA, 1617 nt, Artificial Sequence
  derived and/or modified sequence opt5 from VP1__Norovirus_and/or_Norovirus-like__KF060018
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccggcccuuccagcgccuucgugguucagccccagaacgggcgguguacaaccgauggagugcuccugggcacgacacaacugucuccugucaauauuugcaccuuucgcggggacgugacacauaucuccggaagcagaaacuacaccaugaaucucgccucccagaacuggaacucuuaugaucccaccgaggaaaucccugcuccccugggcacaccggacuucgucggcaaaauucagggggugcuuacgcagaccacacggaccgacggaagcacacgcggccacaaggcgaccguuuacacgggguccgccgauuuuagcccuaagcugggaagagugcaauucgcuacagacaccgauaaugacuuugucaccaaucagaacacaaaauucacccccgugggcguuauccaggaugggucuacaacgccccggaaugagccucaacagugggugcucccguccuacagcggacgcaacacccauaauguccaccuggcccccgccguggcuccuacauuucccggcgaacagcuucuguucuuuagaucuaccaugccuggcuguagcggguaucccaacauggaccucgauugccugcugccucaggagugggugcaauacuucuaucaggaagccgcgcccgcucaguccgacguugcccuccugcgguuugucaauccggauacaggaagagugcuuuucgaguguaagcugcacaaaucuggcuacgugaccgucgcccauacggggcagcacgaccucgugauuccucccaacggauauuuucgcuucgauagcuggguuaaccaauucuacacccuggcuccuaugggcaaugggacaggccggagacgcuga

SEQ ID NO: 30072 - RNA, 1617 nt, Artificial Sequence
  derived and/or modified sequence opt5 from VP1__Norovirus_and/or_Norovirus-like__KC517365
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggauacgacacaacugucccccgugaacaucugcaccuuucgcggggacgucacacauaucgcuggaagcagaaauuacaccaugaaccucgcgucucugaauuggaacaauuaugauccuaccgaagagauucccgccccucuuggcacacccgacuucgugggcaaaauccaggggaugcugacgcagaccacaaagggagacggcuccacccgggggcacaaggcuacagucuacaccggaagcgccccguuuacgccuaaacucggcuccgugcaguucgaaacagauaccgagaacgacuuugaaacccaucaaaauacaaaguucacccccguuggggugauucaggauggaggcacaacgcaccgcaacgagccccagcaauggguccugccuucuuacagcggcagaaaugugccgaacgcccaccuugcucccgccguugcgccuaccuuucccggggagcagcuccuguucuuucgguccacaaugccuggauguagcggcuaucccaauauggaccuggauugccugcucccucaggaaugggugcagcauuucuaccaagaggcugcccccgcccagucugacgucgcucugcuucgcuuugugaacccggauaccgggagagugcuguucgaauguaaacuccacaaguccggauauguuacagccgcucauaccggccagcacgaccuggucaucccucccaacggguacuuucgguucgauagcugggugaaucaguucuauacgcuugccccuaugggcaacggaaccggcagacgccgguga

SEQ ID NO: 30073 - RNA, 1617 nt, Artificial Sequence
  derived and/or modified sequence opt5 from VP1__Norovirus_and/or_Norovirus-like__KC517360
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaaugcugacgcagaccgcuaagggcgacgggagcacacggggacacaaggccaccgucuacacaggcuccgccccguuuaccccuaaacucgggucugugcaguucgaaacggacacagagaaugauuuugaaacccaucaaaacaccaaguucacacccguuggagugauucaggacggcggcaccacacaccgcaaugagccccagcaauggguccugccuagcuacuccgggagaaacgugccgaauguucaccuugcucccgccguggcgccuacguuucccggagagcagcuccuguucuuucggagcaccaugccuggcuguucugggugccccgauauggaccuggauugucugcucccucaggaauggguccagcauuucuaucaagaggcugcccccgcccaguccgacguggcucugcuucgcuuugugaacccggauacaggaagaguucuguucgaaugcaaacuccacaagagcggcuacgucaccguggcccauacagggcagcacgaccugaucauuccucccaauggcuauuuucgguucgauucuugggugaaccaguucuacacccuugcuccuaugggaaacggcacggggagacgccgguga

SEQ ID NO: 30074 - RNA, 1617 nt, Artificial Sequence
  derived and/or modified sequence opt5 from VP1__Norovirus_and/or_Norovirus-like__JX846928
augaagauggccagcuccgacgcuucucccagcgauggcuccaccgccaaccuggugccugaggucaauaacgaaguuauggcgcucgagccgguggcuggggccgccaucgcugcccccguggcuggacagcaaaaugucauugacccuuggaucagaaacaauuucgugcaggcccccggcggggaauuuacaguuucuccucggaacgcgcccggagagauucuguggagcgccccucuuggcccggaucugaaucccuaccucucccaccuggcucgcauguauaacggguacgccggaggcuucgaagugcaggucauccuugcuggcaaugccuuuacggcggggaaaauuaucuucgccgcugugccucccaacuuuccuaccgagggacugucucccagccagguuacaauguucccgcauaucauuguggacgucagacaacucgagccugugcugaucccccugccugaugugcggaauaacuuuuaucacuacaaucagcucaacgaccccaccauuaagcugaucgccaugcuuuauacaccccugcgcgcuaauaacgccggcgaugacgucuucaccguuuccugcagagugcucacacggccuagcccggauuuugacuucauuuuucuggugcccccuaccgucgaaucucgcacgaaacccuucuccgugccuguucuuaccguggaggaaaugacaaacagcagauuucccaucccgcuggagaagcuguucaccgggccuucuuccgccuucgucgugcagccccagaauggacgguguacaaccgauggcguucugcuggggacgacacaacucagcccugugaacauuugcaccuuucgcggagacgucacacauaucucuggcuccagaaauuacaccaugaaccuggcuagccagaauuggaacuccuaugaucccaccgaggaaaucccugcgccccuuggcacaccggacuucguggggaaaauucagggaguccugacgcagaccacacggaccaauggcucuacacgcgggcacaaggccaccguguacacgggaagcgcugacuuuuccccuaagcucggcagaguucaauucgccacagauaccgacaacgauuuugagaccaaucagaacacaaaauucacccccgugggggucauccaggacggaaauacaacgccccggaacgaaccucaacagugggugcugccgagcuacucuggccgcaauauucagaacguucaucuugcccccgcuguggccccuaccuuucccggcgagcagcuccucuucuuuagauccacaaugccuggguguagcggauaucccaauauggaucuggacugccugcucccucaagaauggguccaguacuucuaucaggaggcggcucccgcccagucugauguggcccugcuucgguuugugaacccggacaccggcagaguucuguucgaguguaagcuccacaaaagcggguacgucacaguggcucacaccggacaacaugaucuggugaucccucccaacggcuauuuucgcuucgacuccugggucaaucaguucuacacgcuugccccuauggggaacggcaccggacggagacgcuga

SEQ ID NO: 30075 - RNA, 1617 nt, Artificial Sequence
  derived and/or modified sequence opt5 from VP1__Norovirus_and/or_Norovirus-like__JX459904
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggaaugcuuacgcagaccacacggaccgacggcucuacacgcgggcacaaggcgaccguguacacgggaagcgccgauuuuuccccuaagcugggcagaguucaauucgcuacagacaccgauaaugacuuugugaccaaucagaacacaaaauucacccccgucggggugauccaggauggaagcacaacgccccggaaugagccucaacaguggguucucccgucuuacuccggccgcaacacccauaaugugcaccuggcccccgccgucgcuccuacauuucccggcgaacagcuucuguucuuuagaagcaccaugccuggguguucuggauaucccaacauggaccucgauugccugcugccucaggagugggugcaauacuucuaucaggaagccgcgcccgcucagagcgacguggcccuccugcgguuuguuaauccggauacaggcagaguccuuuucgaguguaagcugcacaaaaccggguacgugacgguggcccauaccggacagcacgaccucgucauuccucccaacggcuauuuucgcuucgauuccugggugaaccaauucuacacacuggcuccuauggggaauggcaccggacggagacgcuga

SEQ ID NO: 30076 - RNA, 1617 nt, Artificial Sequence
  derived and/or modified sequence opt5 from VP1__Norovirus_and/or_Norovirus-like__JX459649
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuuuccaucccccuugagaagcuguucaccgggccgagcucugccuucgugguucagccucagaauggacgguguacaaccgauggcgugcuccuggggacgacacaacugucccccgucaacauuugcaccuuucgcggagacgugacacauaucccuggcagcagaaauuacaccaugaaccucgccucccagaauuggaacucuuaugaucccaccgaggaaaucccugcuccccugggcacaccggacuucgucgggaaaauucagggagugcuuacgcagaccacacggaccaauggcagcacacgcgggcacaaggcgaccguuuacacgggauccgccgacuuuagcccuaagcugggcagagugcaauucgcuacagauaccgacaacgauuuugagaccaaucagaacacaaaauucacccccgucggggugauccaggacggaucuacaacgccccggaaugaaccucaacaguggguucucccguccuacagcggccgcaacauucauaaugugcaccuggcccccgccgucgcuccuaccuuucccggcgagcagcuucuguucuuuagaucuacaaugccuggguguagcggauaucccaacauggaucucgacugccugcugccucaggaaugggugcaauacuucuaucaggaggccgcgcccgcucaguccgauguggcccuccugcgguuuguuaauccggacaccggcagaguccuuuucgaguguaagcugcacaaaucuggguacgugacaguggcccauaccggacagcacgaucucgucaucccucccaacggcuauuuucgcuucgacagcugggugaaccaauucuacacgcuggcuccuauggggaauggcaccggacggagacgcuga

SEQ ID NO: 30077 - RNA, 1617 nt, Artificial Sequence
  derived and/or modified sequence opt5 from VP1__Norovirus_and/or_Norovirus-like__JX459643
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagaguggaguucgcuacagauaccgacaaugauuuugaaaccaaccaaaauacaaaauucacccccgucggggugauccaggacggauccacaacgccucggaacgagccgcagcaauggguucuccccagcuacucuggccgcaauauucauaacgugcaccuggccccugccgucgcucccaccuuuccuggcgaacagcuucuguucuuuagauccacaaugcccggguguagcggauauccuaauauggaucucgacugccugcugccccaggagugggugcaguacuucuaucaagaggccgcgccggcucagucugauguggcccuccugcgguuuguuaacccugacaccggcagaguccuuuucgaauguaagcugcacaaaagcggguacgugacaguggcccauaccggacagcacgaucucgucauucccccuaacggcuauuuucgcuucgacuccugggugaaucaguucuacacgcuggcucccauggggaacggcaccggacggagacgcuga

SEQ ID NO: 30078 - RNA, 1617 nt, Artificial Sequence
  derived and/or modified sequence opt5 from VP1__Norovirus_and/or_Norovirus-like__JX459602
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucacaguguccugcagagugcugacccggcccagccucgacuuugauuucauuuuucuggucccuccgacaguggagucucgcaccaaacccuucacgguuccuauccuuaccguggaagagaugacaaacuccagauuucccauuccucuggagaaacucuucaccgggcccagcggagccuucgucgugcagccgcagaauggccgguguacaaccgacgggguucugcugggaacgacacaacucucuccugugaacaucugcaccuuucgcggcgaugucacacauaucgcuggcuccagaaauuacaccaugaaccuggcgagccuuaauuggaacaauuaugaccccaccgaagagaccccugcuccccuggggacgccugauuucgugggaaagauucagggcguccucacccagacaaccaagggggacggaucuacacggggccacaaggccaccguguacacgggguccgcccccuuuacaccgaaacugggaagcguucaguucuccaccgacaccgaaaacgauuuugagacacaucaaaauaccaaguucacaccugugggcgucauccaggacggcgggacgacccaccgcaacgaaccccagcaaugggugcuucccucuuacagcggaagaaauguucacaacgugcaucuggccccugcugucgccccgacauuucccggcgagcagcuccuguucuuucgguccaccaugccuggguguagcggauaucccaauauggaucuggacugccuccugccucaggagugggugcagcacuucuaccaagaagcggcucccgcccagucugauguggcccuucugcgcuuuguuaacccugacacaggcagaguccucuucgaguguaaacugcauaaguccggguaugugaccguggcucacacgggccagcacgaucuugucauucccccgaacggauacuuucgguucgacagcugggugaaucaguucuauacccuggccccuaugggcaacgggacaggaagacgccgguga

SEQ ID NO: 30079 - RNA, 1617 nt, Artificial Sequence
  derived and/or modified sequence opt5 from VP1__Norovirus_and/or_Norovirus-like__LC177655
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggcgcgccccucuuggcccggaucugaaccccuaccucucucaccuggcuagaauguauaauggguacgccggaggcuucgaaguccaggugauccuugcuggcaacgccuuuacagcggggaaaguuauuuucgccgcugugccucccaauuuuccuacggagggacugagccccucccaggucaccauguucccgcauaucgugguggacguccggcaacucgagccuguucugaucccccugccugaugugcgcaacaauuuuuaucacuacaaccagucuaaugaccccacaauuaagcucaucgccaugcuguauacaccccuuagagcuaacaacgccggcgaugacguguucaccgucagcugccgggugcugacccgcccuuccccggauuuugacuucauuuuucucguucccccuacaguggaaagcagaaccaaacccuucucugucccugugcugacgguugaggaaaugaccaauucccgguuucccaucccgcuugagaagcuguucacagggccuagcucugccuucgugguccagccccagaacggacgcuguaccacagauggcgugcuccuggggaccccucaacugucccccgucaauauuugcacguuuagaggagacgugacacauaucaccggcagccggaacuacacaaugaaucucgcuucucagaacugguccaauuaugauccuaccgaggaaauucccgcgccgcugggcaccccugacuucguugggaaaauccagggagugcuuacacagacgacccgcacagacggcagcaccagagggcacaaggccacagucuacaccggauccgcugauuuugcccccaagcugggccgggugcaauucgagacggacacagaucgcgacuuugaagccaaccagaauaccaaauucacccccguuggggugauccaggauggaucuacaacccauagaaacgagccucaacaguggguccucccgagcuacuccggccggaauacacccaacgugcaccuggcuccugccguggcgcccacguuuccuggcgaacagcuucuguucuuuagaagcaccaugcccggguguucuggauauccuaauauggaccucgauugccugcugccccaggaguggguucaauacuucuaucaggaggcugccccggcccaguccgacgucgcucuccugcgcuuugugaacccugauacaggccgggugcuuuucgaauguaagcugcacaaaagcggguacgucaccguggcccauacaggacagcacgaccucguuauucccccuaauggcuauuuuagauucgauucuugggugaaccaauucuacacccuggcucccauggggaacggcacgggacgccggagauga

SEQ ID NO: 30080 - RNA, 1617 nt, Artificial Sequence
  derived and/or modified sequence opt5 from VP1__Norovirus_and/or_Norovirus-like__KP784698
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcagaaacuacaccaugaaucucgccucccagaacuggaacucuuaugauccuaccgaggaaauccccgcuccucugggcacacccgacuucgucgggaaaauucagggagugcuuacgcagaccacacggaccgacggcagcacacgcgggcacaaggcgaccguuuacacgggauccgccgauuuuacaccgaagcugggcagagugcaauucgcuaccgacaccgauaaugacuuugucacaaaucagaacaccaaauucacaccuguggggguuauccaggauggaagcacgacaccccggaaugagccccaacagugggugcucccuucuuacuccggccgcaacacccauaauguccaccuggccccggccguggcucccaccuuuccuggcgaacagcuucuguucuuuagaagcacaaugcccggguguucuggauauccuaacauggaccucgauugccugcugccccaggagugggugcaauacuucuaucaggaagccgcgccugcucagagcgacguugcccuccugcgguuugucaaucccgauaccggcagagugcuuuucgaguguaagcugcacaaauccggguacgugacggucgcccauaccggacagcacgaccucgugauuccgccuaacggcuauuuucgcuucgauucuuggguuaaccaauucuacacacuggcucccauggggaauggcaccggacggagacgcuga

SEQ ID NO: 30081 - RNA, 1617 nt, Artificial Sequence
  derived and/or modified sequence opt5 from VP1__Norovirus_and/or_Norovirus-like__KX354104
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacaucggaucugcugauuuugccccuaagcugggcagagugcaauucgagacggacacagaucaugacuuugaagccaaccagaauaccaaauucacccccguuggggugauucaggauggaggcacaacccaccggaacgagccccaacaguggguccucccuagcuacuccggccgcaauacaccgaacgugcaccuggcucccgccguggcgccuacguuucccggggaacagcuucuguucuuuagaagcaccaugccuggauguucuggcuaucccaauauggaccucgauugccugcugccucaggaguggguucaauacuucuaucaggaggcugcccccgcccaguccgacgucgcucuccugcgguuugugaacccggauacagggagagugcuuuucgaauguaagcugcauaaaagcggauacgucaccguggcccacacaggccagcaugaccucguuaucccucccaauggguauuuucgcuucgauucuugggugaaccaauucuacacccuggcuccuaugggcaacggaacgggccggagacgcuga

SEQ ID NO: 30082 - RNA, 1617 nt, Artificial Sequence
  derived and/or modified sequence opt5 from VP1__Norovirus_and/or_Norovirus-like__KR904211
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgcuauugacccuuggaucagaaauaacuucgugcaggcccccggcggggaauuuacaguuuccccucggaaugcgcccggagagauucuguggucugccccucuuggcccggaucugaaccccuaccucagccaccuggcucgcauguauaauggguacgccggaggcuucgaagugcaggucauccuugcuggcaacgccuuuacggcggggaaaauuaucuucgccgcugugccucccaauuuuccuaccgagggacugucccccucucagguuacaauguucccgcauaucauuguggacgucagacaacucgagccugugcugaucccccugccugaugugcggaacaauuuuuaucacuacaaccagagcaaugacuccaccauuaagcucaucgccaugcuguauacaccccuucgcgcuaacaacgccggcgaugacgucuucaccguuagcugcagagugcugacacggcccucuccugauuuugacuucauuuuucucgugccgcccaccgucgaaucccgcacgaaaccuuucagcgugcccauccugaccguugaggaaaugacaaauucuagauuuccuauuccccuugagaagcuguucaccgggccguccagcgccuucgugguccagccucagaacggacgguguacaaccgauggcgugcuccuggggacgacacaacugucucccguuaauaucugcaccuuucgcggagacgugacacauaucgcuggcuccagaaacuacaccaugaaucucgcgagccagaacuggaacuccuaugauccuaccgaggaaauucccgccccucugggcacacccgacuucgucgggaaaauccagggagugcuuacgcagaccacacggaccgacggcucuacacgcgggcacaaggcuaccgucuacacgggaagcgccgauuuuuccccgaagcugggcagagugcaauucgccacagacaccgauaaugacuuugaugcuaaucagaacaccaaauucacaccuguuggggugauucaggacggaggcaccacacaucggaaugagccccaacaguggguccuccccagcuacucuggccgcaacauccacaaugugcaccuggccccugcgguugcuccgacguuucccggggaacagcuucuguucuuuagauccaccaugccuggauguagcggcuaucccaacauggaucucgacugccugcugccucaggagugggugcaauacuucuaucaggaagccgcccccgcucagucugaugucgcccuccugcgguuugugaauccugacacagggagagugcuuuucgaguguaagcugcauaaaagcggauacguuaccgucgcucacacaggccagcaugaucucgugauucccccgaacggguauuuucgcuucgacuccugggugaaccaauucuacacccuggccccuaugggcaauggaacgggccggagacgcuga

SEQ ID NO: 30083 - RNA, 1617 nt, Artificial Sequence
  derived and/or modified sequence opt5 from VP1__Norovirus_and/or_Norovirus-like__AB933743
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcagaaacuacaccaugaaucucgccucccagaacuggaacucuuaugauccuaccgaggaaauccccgcuccucugggcacacccgacuucgucgggaaaauucagggagugcuuacgcagaccacacggaccaauggcagcacacgcgggcacaaggcgaccguuuacacgggauccgccgacuuuagcccgaagcugggcagagugcaauucgcuacagauaccgacaaugauuuugagaccaaccagaauacaaaauucaccccugucggggugauccaggacggaucuacaacgccccggaacgaaccccaacaguggguucucccuuccuacagcggccgcucuauucauaaugugcaccuggccccggccgucgcucccaccuuuccuggcgagcagcuucuguucuuuagaagcacaaugcccggguguuccggauauccuaacauggaucucgacugccugcugccccaggaaugggugcaauacuucuaucaggaggccgcgccugcucagucugauguggcccuccugcgguuuguuaaucccgacaccggcagaguccuuuucgaguguaagcugcacaaaagcggguacgugacaguggcccauaccggacagcacgaucucgucaucccgccuaacggcuauuuucgcuucgacuccugggugaaccaauucuacacgcuggcucccauggggaauggcaccggacggagacgcuga

SEQ ID NO: 30084 - RNA, 1617 nt, Artificial Sequence
  derived and/or modified sequence opt5 from VP1__Norovirus_and/or_Norovirus-like__LN854572
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugauccauauccccggcucuagaaacuacacaaugaaucucgccucccagaacuggaauagcuaugauccuaccgaggaaauucccgcuccgcugggcaccccugacuucgucgggaaaauccagggagugcuuacacagacgacccggacaaacggcuccacccgcgggcacaaggcgacaguuuacaccggaucugccgacuuuagccccaagcugggcagagugcaauucgcuacggauacagacaaugauuuugagaccaaccagaauaccaaauucacacccgucggggugauucaggacggauccaccacaccucggaacgaaccgcaacaguggguucuccccagcuacucuggccgcaauauccauaacgugcaccuggccccugccgucgcucccacguuuccuggcgagcagcuucuguucuuuagauccaccaugcccggguguagcggauauccuaauauggaucucgacugccugcugccccaggaaugggugcaauacuucuaucaggaggccgcgccggcucagucugauguggcccuccugcgguuuguuaacccugacacaggcagaguccuuuucgaguguaagcugcacaaaagcggguacgugaccguggcccauacaggacagcacgaucucgucauucccccuaacggcuauuuucgcuucgacuccugggugaaucaauucuacacccuggcucccauggggaacggcacgggacggagacgcuga

SEQ ID NO: 30085 - RNA, 1617 nt, Artificial Sequence
  derived and/or modified sequence opt5 from VP1__Norovirus_and/or_Norovirus-like__KP244319
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugagcaucccccugccugauguccggaacaauuuuuaucacuacaaccaguccaaugaccccaccauuaagcugaucgcuaugcucuauacaccccugcgcgccaacaacgcuggcgaugacguuuucaccgugagcugcagagugcuuacacggccuucuccggauuuugacuucauuuuucuggugcccccuaccgucgaaucccgcacgaaacccuucagcguuccugugcucaccgucgaggaaaugacaaauucuagauuucccaucccgcuggagaaacuuuucaccgggccuuccagcgccuucgugguucagccccagaacggacgguguacaaccgauggcgugcugcucgggacgacacaacugucuccugucaauauuugcaccuuucgcggagacgugacacauauccccggcuccagaaacuacaccaugaaucuggccagccagaacuggaacuccuaugauccuaccgaggaaauccccgcuccgcucggcacaccugacuucgucgggaagauucagggagugcugacgcagaccacacgggcgaauggcucuacccgcgggcacaaggccacaguuuacaccggaagcgcugacuuuucccccaaacuuggcagagugcaauucgccacggauacagacaaugauuuugagaccaaccagaauaccaaguucacacccgucggggugauccaggacggaagcaccacaccucggaacgaaccgcaacaguggguucugcccucuuacuccggccgcaauauucauaacgugcaccucgccccugcugucgcccccacguuuccuggcgagcagcugcuuuucuuuagaagcaccaugcccggguguucuggauauccuaauauggaucuggacugccuccugccccaggaaugggugcaauacuucuaucaggaggcggcuccggcccagagcgauguggcccugcuccgguuuguuaacccugacacaggcagaguccuguucgaguguaaacuucacaaguccggguacgugaccguggcucauacaggacagcacgaucuggucauucccccuaacggcuauuuucgcuucgacucuugggugaaucaauucuacacccucgcccccauggggaacggcacgggacggagacgcuga

SEQ ID NO: 30086 - RNA, 1617 nt, Artificial Sequence
  derived and/or modified sequence opt5 from VP1__Norovirus_and/or_Norovirus-like__KF768470
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucuccauuugcaccuuucgcggagacgugacacauaucccuggcagccacaauuacaccaugaaccucgccucccagaauuggaacucuuaugaucccaccgaggaaaucccugcuccccugggcacaccggacuucgucgggaaaauucagggagugcuuacgcagaccacaagaaccaauggcagcacacgggggcauaaggcgaccguuuacacgggauccgccgacuuuagcccuaagcugggccgcgugcaauucgcuacagauaccaacaaugacuuugagaccaaccagaauacaaaauucacccccgucggggugauccaggauggaucuacaacgcccagaaacgaaccucaacaguggguucucccguccuacagcggccggaauauucacaacgugcaccuggcccccgccgucgcuccuaccuuucccggcgagcagcuucuguucuuucgcucuacaaugccuggguguagcggauaucccaauauggaccucgauugccugcugccucaggaaugggugcaauacuucuaucaggaggccgcgcccgcucaguccgacguggcccuccugagauuuguuaacccggauaccggccggguccuuuucgaguguaagcugcauaaaucuggguacgugacaguggcccacaccggacagcaugaccucgucaucccucccaacggcuauuuuagauucgauagcugggugaaucaauucuacacgcuggcuccuauggggaacggcaccggacgccggagauga

SEQ ID NO: 30087 - RNA, 1617 nt, Artificial Sequence
  derived and/or modified sequence opt5 from VP1__Norovirus_and/or_Norovirus-like__KC456073
augaagauggccagcuccgacgcuaaccccucugauggcagcgccgcgaaucuggugccuaaagucaacaaugagguuauggcucucgaaccgguggugggggccgccaucgcugcccccgucgcuggacagcaaaacgugauugacccuuggaucaagaauaacuucguucaggcccccggcggggaguuuaccguguccccuaaaaaugcgcccggagaaauucuguggucugccccucuuggcccggaucugaaccccuaccucagccaccuggcuagaauguauaauggguacgccggaggcuucgagguccaggugauccuugcuggcaacgccuuuacagcggggaagguuauuuucgccgcugugccucccaauuuuccuacggaaggacugucccccucucaggucaccauguucccgcauaucgugguggacguccggcaacucgagccuguucugaucccccugccugaugugcgcaacaauuuuuaucacuacaaccagagcaaugaccccacaauuaaacucaucgccaugcuguauacaccccuuagagcuaacaacgccggcgaugacguguucaccgucuccugccgggugcugacccgcccuagcccggauuuugacuucauuuuucucguucccccuacaguggagucuagaaccaagcccuucuccgucccugugcugacgguugaagagaugaccaauagccgguuucccaucccgcuugaaaagcuguucacagggccuucuuccgccuucgugguccagccccagaacggacgcuguaccacagauggcgugcuccuggggaccacgcaacugagcccugucaauauuugcacauuuagaggagacgugacccauaucacaggcucucggaacuacaccaugaaucucgcuucccagaacuggaauaacuaugaucccaccgaggagauuccugcgccccugggcacaccggacuucguugggaaaauccagggagugcuuacgcagaccacacgcaccgacggcagcacaagagggcacaaggccaccgucuacacgggauccgcugauuuugccccuaaacugggccgggugcaauucgaaacagacaccgaucaugacuuugaggccaaucagaacaccaaguucacacccguuggggugauccaggauggaggcaccacacaccgcaaugaaccccaacaguggguccucccuucuuacagcggcagaaacacgcacaaugugcaucuggcuccggccguggcgcccaccuuuccuggggagcagcuucuguucuuucgguccacaaugcccggauguagcggcuauccuaacauggaccucgauugccugcugccccaggaauggguucaauacuucuaucaggaggcugccccugcccagucugacgucgcucuccugcgcuuugugaaucccgauaccgggagagugcuuuucgaguguaaacugcacaaguccggauacgucacaguggcccauaccggccagcacgaccucguuauuccgccuaacggguauuuucgguucgauagcugggugaaccaauucuacacgcuggcucccaugggcaauggaaccggcagacgccgguga

SEQ ID NO: 30088 - RNA, 1617 nt, Artificial Sequence
  derived and/or modified sequence opt5 from VP1__Norovirus_and/or_Norovirus-like__KC456072
augaagauggccagcuccgacgcuaaccccucugauggcagcgccgcgaaucuggugccuaaagucaacaaugagguuauggcucucgaaccgguggugggggccgccaucgcugcccccgucgcuggacagcaaaacgugauugacccuuggaucaagaauaacuucguucaggcccccggcggggaguuuaccguguccccuaaaaaugcgcccggagaaauucuguggucugccccucuuggcccggaucugaaccccuaccucagccaccuggcuagaauguauaauggguacgccggaggcuucgagguccaggugauccuugcuggcaacgccuuuacagcggggaagguuauuuucgccgcugugccucccaauuuuccuacggaaggacugucccccucucaggucaccauguucccgcauaucgugguggacguccggcaacucgagccuguucugaucccccugccugaugugcgcaacaauuuuuaucacuacaaccagagcaaugaccccacaauuaaacucaucgccaugcuguauacaccccuuagagcuaacaacgccggcgaugacguguucaccgucuccugccgggugcugacccgcccuagcccggauuuugacuucauuuuucucguucccccuacaguggagucuagaaccaagcccuucuccgucccugugcugacgguugaagagaugaccaauagccgguuucccaucccgcuugaaaagcuguucacagggccuucuuccgccuucgugguccagccccagaacggacgcuguaccacagauggcgugcuccuggggaccacgcaacugagcccugucaauauuugcacauuuagaggagacgugacccauaucacaggcucucggaacuacaccaugaaucucgcuucccagaacuggagcaauuaugaucccaccgaggagauuccugcgccccugggcacaccggacuucguugggaaaauccagggagugcuuacgcagaccacacgcaccgacggcuccacaagagggcacaaggccaccgucuacacgggaucugcugauuuugccccuaaacugggccgggugcaauucgaaacagacaccgaucgcgacuuugaggccaaccagaauaccaaguucacacccguuggggugauccaggauggaagcaccacacauagaaacgaaccccaacaguggguccucccuuccuacagcggccggaauacgccgaacgugcaccuggcucccgccguggcgccuaccuuucccggcgagcagcuucuguucuuucgcucuacaaugccuggguguuccggauaucccaauauggaccucgauugccugcugccucaggaauggguucaauacuucuaucaggaggcugcccccgcccagagcgacgucgcucuccugagauuugugaacccggauaccggccgggugcuuuucgaguguaaacugcacaagucuggguacgucacaguggcccauaccggacagcacgaccucguuauuccucccaauggcuauuuuagauucgauagcugggugaaccaauucuacacgcuggcuccuauggggaacggcaccggacgccggagauga

SEQ ID NO: 30089 - RNA, 1617 nt, Artificial Sequence
  derived and/or modified sequence opt5 from VP1__Norovirus_and/or_Norovirus-like__JX459622
augaagauggccagcaacgacgcucaccccuccgauggcucugccgcgacccuggugccuaaagucaauaacgagguuauggcucucgaaccgguggugggggccgccaucgcugcccccgucgcuggacagcaaaaugugauugacccuuggaucagaaacaauuucguucaggcccccggcggggaguuuacagugagcccucggaacgcgcccggagaaauucugugguccgccccucuuggcccggaucugaaucccuaccucucucaucuggcucgcauguauaacggguacgccggaggcuucgagcuucacguccugcucgcuggcaaugccuuuacggcggggaagaucauuaucgccgcugugccucccaacuucccuaccgaaggacugagccccucccagguuacaauguuuccgcauaucauuguggacgucagacagcuggagccugugcucaucccccugccugaugugcggaauaacuucuaucacuacaaucaaucuaacgacagcaccauuaaacuuaucgccaugcuguauacaccccuccgcgcuaauaacgccggcgaggaugucuuuaccguuuccugcagagugcugacacggcccagcccugacuucgauuuuauuuuccuugugccgcccaccgucgaaucucgcacgaagccuuuuaccgugcccauccugacaguugaggaaaugaccaacuccagauucccuauuccccucgagaaacuguuuacagggccgagcggagccuucgugguccagccucagaauggccgguguaccacggacggggugcugcucggaacaacccagcugucucccguuaacaucugcaucuuccgcggcgaugugacacauauugcuggcuccagaaauuacaccaugaaccuugcggcccugaauuggaacaauuaugacccuaccgaggaaauccccgcuccucucgggacacccgauuuugucggaaagauucaaggcgugcugacgcagaccacaaagggggacggaagcacccggggccacaaagccacagucuacaccgggucugccgacuucacgccgaaacuuggauccgugcaguuuagcacagauaccgagaacgacuucgaaacccaccagaauacaaaguuuaccccuguuggcgugauccaagauggcuccacaacgcaucgcaacgagccccagcaguggguccugcccucuuacagcgggagaaaugugcacaacguucaucucgcuccugccguggcgccgaccuuccccggagaacaacugcuguuuuuccgguccacaaugccuggcuguagcggguaucccaauauggaccucgauugccugcuuccucaggaguggguccagcacuuuuaccaggaggcugcccccgcccaaucugacguggcucugcuccgcuucgugaacccugauaccggaagaguucuguuugaauguaaacuucacaaguccggcuaugucacaguggcccauaccgggcagcacgaccuggugauucccccgaauggcuacuuccgguuugauagcugggucaaccaguucuauacgcucgcuccuaugggaaacggcaccgggagacgccgguga

SEQ ID NO: 30090 - RNA, 1617 nt, Artificial Sequence
  derived and/or modified sequence opt5 from VP1__Norovirus_and/or_Norovirus-like__KX514290
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccauccugaccgugggggagaugacgaacucuagauuuccuauuaaucuugaacggcuguucaccggacccuccagcgccaacgucgugcagccgcagaauggccgcuguacaaucgauggggagcuccugggaaccacacaacugucuuccguuaacaucugcaccuucagaggcgacgugacgcauauuggcagcacacaccauuggaccaugaaucucgcuuccccuaacuggaauaacuacgaucccacagaggaaaccccugcgccccuggggaccccugacuuugucggaaagauccacggcaugcuuacacagacgacccaggagaaugggucuacacgggcccaccgcgcuaccguguaugucggaagcgccgacuucacacccaaacugggcaaggugcaguuugaaaccgauacgacaaacgaccucgaugcccaucaaaauaccaaguucaccccgguuggggugguccagggaggcgaguccccuaaaggcagcgaaccccagcaaugggugcugcccucuuacuccgggagagacacaccuaacguucaccuugcuccggccguggcgcccaccuuuccuggagagcagcuccuguucuuucggagcacaauucccggcugugggggacauccuaauaugaaccuggauugccugcucccccaggaguggguccagcacuucuaccaagaagcugccccugcccagucugacguggcucugcuucgcuuugugaaccccgauacgagcagaguucuguucgaguguaagcuccacaaauccggcuaugucaccguggcccauacagggcagcacgaccuggugaucccgccuaauggcuacuuucgguucgauucuugggucaaccaguuuuauacccuugcucccaugggaaauggcacagggagaaagcgcuga

SEQ ID NO: 30091 - RNA, 1617 nt, Artificial Sequence
  derived and/or modified sequence opt5 from VP1__Norovirus_and/or_Norovirus-like__KP784695
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcagaaacuacaccaugaaucucgccucccagaacuggaacucuuaugauccuaccgaggaaauccccgcuccucugggcacacccgacuucgucgggaaaauucagggagugcuuacgcagaccacacggaccgacggcagcacacgcgggcacaaggcgaccguuuacacgggauccgccgauuuuagcccgaagcugggcagagugcaauucgcuacagacaccgauaaugacuuugucaccaaucagaacacaaaauucaccccuguggggguuauccaggauggaaauacaacgccccggaacgagccccaacagugggugcucccuucuuacuccggccgcaauacccauaacguccaccuggccccggccguggcucccacauuuccuggcgaacagcuucuguucuuuagaagcaccaugcccggguguucuggauauccuaauauggaccucgauugccugcugccccaggagugggugcaauacuucuaucaggaagccgcgccugcucagagcgacguugcccuccugcgguuugucaaccccgauacaggcagagugcuuuucgaguguaagcugcacaaauccggguacgugaccgucgcccauacgggacagcacgaccucgugauuccgccuaacggcuauuuucgcuucgauucuuggguuaaucaauucuacacccuggcucccauggggaacggcacaggacggagacgcuga

SEQ ID NO: 30092 - RNA, 1617 nt, Artificial Sequence
  derived and/or modified sequence opt5 from VP1__Norovirus_and/or_Norovirus-like__KX608865
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucgccggcuccagaaacuacaccaugaaucucgcuagccagaacuggaacuccuaugauccuaccgaggaaauccccgcgccucugggcacacccgacuucgucgggaaaauucagggagugcuuacgcagaccacacggaccgacggcucuacacgcgggcacaaggccaccguuuacacgggaagcgcugauuuuuccccgaagcugggcagagugcaauucgccacagacaccgauaaugacuuugucaccaaucagaacacaaaauucaccccuguggggguuauccaggauggaagcacaacgccccggaaugagccccaacagugggugcucccuucuuacuccggccgcaacacccauaauguccaccuggccccggcuguggcccccacauuuccuggcgaacagcuucuguucuuuagaagcaccaugcccggguguucuggauauccuaacauggaccucgauugccugcugccccaggagugggugcaauacuucuaucaggaagcggcuccugcccagagcgacguugcccuccugcgguuugucaaucccgauacaggcagagugcuuuucgaguguaagcugcacaaauccggguacgugaccgucgcucauacgggacagcacgaccucgugauuccgccuaacggcuauuuucgcuucgauucuuggguuaaccaauucuacacccuggcccccauggggaauggcacaggacggagacgcuga

SEQ ID NO: 30093 - RNA, 1617 nt, Artificial Sequence
  derived and/or modified sequence opt5 from VP1__Norovirus_and/or_Norovirus-like__AB972500
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcagaaacuacaccaugaaucucgccucccagaacuggaacucuuaugauccuaccgaggaaauccccgcuccucugggcacacccgacuucgucgggaaaauucagggagugcuuacgcagaccacacggaccaauggcagcacacgcgggcacaaggcgaccguuuacacgggauccgccgacuuuagcccgaagcugggcagagugcaauucgcuacagauaccgacaaugauuuugagaccaaccagaauacaaaauucaccccugucggggugauccaggacggaucuacaacgccccggaacgaaccccaacaguggguucucccuuccuacagcggccgcaauauucauaacgugcaccuggccccggccgucgcucccaccuuuccuggcgagcagcuucuguucuuuagaucuacaaugcccggguguagcggauauccuaauauggaucucgacugccugcugccccaggaaugggugcaauacuucuaucaggaggccgcgccugcucaguccgauguggcccuccugcgguuuguuaaccccgacaccggcagaguccuuuucgaguguaagcugcacaaaucuggguacgugacaguggcccauaccggacagcacgaucucgucaucccgccuaacggcuauuuucgcuucgacagcugggugaaucaauucuacacgcuggcucccauggggaacggcaccggacggagacgcuga

SEQ ID NO: 30094 - RNA, 1617 nt, Artificial Sequence
  derived and/or modified sequence opt5 from VP1__Norovirus_and/or_Norovirus-like__KT033902
augaagauggccagcuccgacgcuaaccccucugauggcagcaccgccaaucugaucccugaggugaacaaugaagucauggcgcucgagccgguugugggggcugccauugccgcucccguggccggacagcaaaacgucaucgacccuuggauuagaaauaacuucgugcaggcucccggcggggaauuuacaguuuccccucggaaugcccccggagagauccuguggucugcgccucuuggcccggaucugaaccccuaccucagccaccuggcccgcauguauaauggguacgcuggaggcuucgaagugcaggucauucuugccggcaacgcuuuuacggccgggaaaaucaucuucgcggccgugccucccaauuuuccuaccgagggacugucccccucucagguuacaauguucccgcauauuaucguggacgucagacaacucgagccugugcugauuccccugccugaugugcggaacaauuuuuaucacuacaaccagagcaaugacuccaccaucaagcucauugcuaugcuguauacaccccuucgcgccaacaacgcuggcgaugacaucuucaccgucagcugcagaguucugacacggcccucuccugauuuugacuucauuuuucucgugccgcccaccguggaaucccgcacgaaaccuuucagcguccccgugcugaccguugaggaaaugacaaauucuagauuuccuaucccccuugagaagcuguucaccgggccguccagcgcccucgugguccagccucagaacggacgguguacaaccgauggcgugcugcuggggacgacacaacucucucccguuaauaucugcaccuuccgcggagacgugacacauauuccuggcuccagaaacuacaccaugaaucuggccagccagaacuggaacuccuaugaucccaccgaggaaaucccugcuccccuuggcacaccggacuuugucgggaaaauucagggagugcugacgcagaccacacggaccaauggcucuacacgcgggcacaaggcgaccgucuacacgggaagcgccgacuucuccccuaagcucggcagagugcaauuugcuacagauaccgacaaugauuucgagaccaaccagaauacaaaauuuacccccguuggggugauccaggacggaagcacaacgccccggaacgaaccucaacaguggguccugccgucuuacuccggccgcaauauucauaacgugcaccuugcccccgccguugcuccuaccuuccccggcgagcagcugcucuuuuucagaagcacaaugccuggguguucuggauaucccaauauggaucuggacugccugcucccucaggaaugggugcaauacuuuuaucaggaggccgcgcccgcucagagcgaugucgcccugcuucgguucgugaacccggacaccggcagagugcuguuugaguguaagcuccacaaauccggguacguuacagucgcccauaccggacagcacgaucuggugaucccucccaacggcuauuuccgcuuugacucuugggugaaucaauucuacacgcuugcuccuauggggaacggcaccggacggagacgcuga

SEQ ID NO: 30095 - RNA, 1617 nt, Artificial Sequence
  derived and/or modified sequence opt5 from VP1__Norovirus_and/or_Norovirus-like__KR904220
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuuguuggcaacgccuuuacggcugggaaaauuaucuucgccgcggugccucccaauuuuccuaccgagggacugucccccucucaggucacaauguucccgcauaucauuguggacgugagacaacucgagccuguccugaucccccugccugauguucggaacaauuuuuaucacuacaaccagagcuccgacagcaccauuaagcucaucgccaugcuguauacaccccuucgcgcuaauaacgccggcgaugacguguucaccgugucuugcagaguccugacacggcccuccccugauuuugacuucauuuuucucgugccgcccaccguugaaagccgcacgaaaccuuucucugugcccguccugaccguggaggaaaugacaaacuccagauuuccuaucccccuugagaagcuguucaccgggccgagcucugcuuucguugugcagccucagaauggacgguguacaaccgauggcguccuccuggggacgacacaacugucccccgugaacauuugcaccuuucgcggagacgucacacauaucagcggcucccacaauuacaccaugaaccucgccucucagaauuggaacagcuaugauccuaccgaggaaauccccgccccucugggcacacccgacuucguggggaaaauucagggaguucuuacgcagaccacaagaaccgacggcuccacacgggggcauaaggcuaccguguacacgggaagcacagauuuuaccccgaagcugggccgcgcgcaauucgccaccgacacagauaaugacuuugagaccaaccagaauacaaaauucacgccugucggggugauccaggauggaggcaccacacacagaaacgaaccccaacaguggguucuccccucuuacuccggccggaauacccacaacgugcaucuggcuccugccgucgccccgacauuucccggggagcagcuucuguucuuucgcagcaccaugccuggauguucuggcuaucccaauauggaccucgauugccugcugccucaggaaugggugcaauacuucuaucaggaggcugcccccgcgcagagcgacguggcucuccugagauuuguuaacccugauacggggcggguccuuuucgaguguaagcugcacaaauccggauacgugaccguggcccauacaggccagcacgaccucgucauucccccgaauggguauuuuagauucgauucuugggugaaccaauucuacacccuggccccuaugggcaacggaacaggccgccggagauga

SEQ ID NO: 30096 - RNA, 1617 nt, Artificial Sequence
  derived and/or modified sequence opt5 from VP1__Norovirus_and/or_Norovirus-like__LN854566
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugucccauaucaccggcagcagaaacuacacaaugaaucucgcuucccagaacuggaauaacuaugauccuaccgaggaaauccccgcgccucugggcacccccgacuucgucgggaaaauucagggaaugcuuacacagacgacccgggccgacggcucuacacgcgggcacaaggcuaccguguacacaggaagcgccgauuuugccccgaagcugggcagaguucaauucgagaccgacacggaucaugacuuugaagcuaaucagaacacaaaauucaccccugugggggucauccaggauggauccaccacacaccggaaugagccccaacagugggugcuccccagcuacucuggccgcaacacccacaauguucaucuggccccugcgguggcuccgacauuucccggcgaacagcuucuguucuuuagauccacgaugccuggguguagcggauaucccaacauggaccucgauugccugcugccucaggaguggguccaauacuucuaucaggaggccgcccccgcucagucugacguggcccuccugcgguuugugaauccugauaccggcagaguucuuuucgaauguaagcugcacaaaagcggguacgucacaguggcucauaccggacagcacgaccucgugauucccccgaacggcuauuuucgcuucgauuccugggucaaccaauucuacacacuggccccuauggggaauggcaccggacggagacgcuga

SEQ ID NO: 30097 - RNA, 1617 nt, Artificial Sequence
  derived and/or modified sequence opt5 from VP1__Norovirus_and/or_Norovirus-like__KP244313
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcagaaacuacaccaugaaucucgccucccagaacuggaacucuuaugauccuaccgaggaaauccccgcuccucugggcacacccgacuucgucgggaaaauucagggagugcuuacgcaggcgacccggacaaauggcagcacccgcgggcacaaggccacaguuuacaccggauccgcugacuuuagcccgaagcugggcagagugcaauucgccacggauacagacaaugauuuugagaccaaccagaauaccaaauucacaccugucggggugauccaggacggaucuaccacaccccggaacgaaccccaacaguggguucucccuuccuacagcggccgcaauauucauaacgugcaccuggccccggcugucgcccccacguuuccuggcgagcagcuucuguucuuuagaucuaccaugcccggguguagcggauauccuaauauggaucucgacugccugcugccccaggaaugggugcaauacuucuaucaggaggcggcuccugcccaguccgauguggcccuccugcgguuuguuaaccccgacacaggcagaguccuuuucgaguguaagcugcacaaaucuggguacgugaccguggcucauacaggacagcacgaucucgucaucccgccuaacggcuauuuucgcuucgacagcugggugaaucaauucuacacccuggcccccauggggaacggcacgggacggagacgcuga

SEQ ID NO: 30098 - RNA, 1617 nt, Artificial Sequence
  derived and/or modified sequence opt5 from VP1__Norovirus_and/or_Norovirus-like__KP096342
augaagauggccagcuccgacgcuaaccccucugauggcagcgccgcgaaucuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggaaugcuuacgcagaccacacggaccgacggcucuacacgcgggcacaaggccaccguguacacgggaagcgcugauuuugccccuaagcugggcagaguccaauucgagacagacaccgaucaugacuuugaagccaaucagaacaccaaauucacacccguggggguuauccaggauggauccaccacacaccggaaugagccccaacagugggugcucccuagcuacucuggccgcaacacgccgaauguccaccuggcucccgccguggcgccuaccuuucccggcgaacagcuucuguucuuuagauccacaaugccuggguguagcggauaucccaacauggaccucgauugccugcugccucaggagugggugcaauacuucuaucaggaggcugcccccgcccagucugacguugcucuccugcgguuugucaauccggauaccggcagagugcuuuucgaauguaagcugcauaaaagcggguacgugacagucgcccacaccggacagcaugaccucgugauuccucccaacggcuauuuucgcuucgauuccuggguuaaucaauucuacacgcuggcuccuauggggaacggcaccggacggaagagauga

SEQ ID NO: 30099 - RNA, 1617 nt, Artificial Sequence
  derived and/or modified sequence opt5 from VP1__Norovirus_and/or_Norovirus-like__KM514067
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggaccucgauugccugcugccucccgaguggguucaguacuucuaucaagaggcugccccggcccaguccgacgucgcucuccugcgguuugugaacccugauaccgggagagugcuuuucgaauguaagcugcauaaaagcggauacgucacaguggcccacaccggccagcaugaccucguuauucccccuaauggguauuuucgcuucgauucuugggugaaccaguucuacacgcuggcucccaugggcaacggaaccggccggagacgcuga

SEQ ID NO: 30100 - RNA, 1617 nt, Artificial Sequence
  derived and/or modified sequence opt5 from VP1__Norovirus_and/or_Norovirus-like__KF060049
augaagauggccagcuccgacgcuaaccccucugauggcagcaccgccaaucuggugccugaggucaacaaugaaguuauggcgcucgagccgguggugggggcugccaucgccgcucccgucgccggacagcaaaacauuaucgacccuuggauuagaaauaacuucgugcaggcucccggcggggaauuuacaguuuccccucggaaugcccccggagagauccuguggucugcgccucuuggcccggaucugaaccccuaccucagccaccuggcccgcauguauaauggguacgcuggaggcuucgaagugcaggucauucuugccggcaacgcuuuuacggccgggaaaaucaucuucgcggccgugccucccaauuuuccuaccgagggacugucccccucucagguuacaauguucccgcauauuaucguggacgucagacaacucgagccugugcugauuccccugccugaugugcggaacaauuuuuaucacuacaaccagagcaaugacuccaccaucaagcucauugcuaugcuguauacaccccuucgcgccaacaacgcuggcgaugacgucuucaccguuagcugcagagugcugacacggcccucuccugauuuugacuucaucuuucucgugccgcccaccgucgaaucccgcacgaaaccuuucagcgugcccguucugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucuccggcagcagaaacuacaccaugaaucucgccucccagaacuggaacucuuaugauccuaccgaggaaauucccgcuccucugggcacacccgacuucguggggaaaauccagggaguccuuacgcagaccacacggaccgacggcagcacacgcgggcacaaggcgaccguguacacgggauccgccgauuuuagcccgaagcugggcagaguucaauucgcuacagacaccgauaaugacuuugugaccaaucagaacacaaaauucaccccugucggggugauucaggauggaucuacaacgccccggaaugagccccaacaguggguucucccuuccuacagcggccgcaacacccauaaugugcaccuggccccggccgucgcucccacauuuccuggcgaacagcuucuguucuuuagaucuaccaugcccggguguagcggauauccuaacauggaccucgauugccugcugccccaggagugggugcaauacuucuaucaggaagccgcgccugcucaguccgacguggcccuccugcgguuuguuaaucccgauacaggcagaguccuuuucgaguguaagcugcacaaaucuggguacgugaccguggcccauacgggacagcacgaccucgucaucccgccuaacggcuauuuucgcuucgauagcugggugaaccaauucuacacccuggcucccauggggaauggcacaggacggagacgcuga

SEQ ID NO: 30101 - RNA, 1617 nt, Artificial Sequence
  derived and/or modified sequence opt5 from VP1__Norovirus_and/or_Norovirus-like__KF059998
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaauuccugcuccccugggcacaccggacuucguggggaaaauccagggaguccuuacgcagaccacaucugcgaauggcagcaccagagggcauaaggccacaguguacaccggauccgcugacuuuagcccuaagcugggccggguucaauucgccacggauacaaauaacgacuuugagaccaaucagaacaccaaauucacacccgugggggucauucaggauggaaauaccacaccccgcaacgaaccucaacagugggugcucccgucuuacuccggcagaaauauccacaacguucaccuggcccccgcuguggccccuacguuucccggcgagcagcuucuguucuuucggagcaccaugccuggguguucuggauaucccaacauggaccucgauugccugcugccucaggaauggguccaauacuucuaucaggaggcggcucccgcccagagcgacguggcccuccugcgcuuugugaauccggauacaggcagaguucuuuucgaguguaagcugcauaaauccggguacgucaccguggcucacacaggacagcaugaccucgugauuccucccaacggcuauuuucgguucgauucuugggucaaucaauucuacacccuggccccuauggggaacggcacgggaagacgccgguga

SEQ ID NO: 30102 - RNA, 1617 nt, Artificial Sequence
  derived and/or modified sequence opt5 from VP1__Norovirus_and/or_Norovirus-like__JX439833
augaagauggccagcuccgacgcuaaccccucugauggcagcaaagccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuaccguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacagccgggaagauuaucuucgcggccguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaaacucaucgcuaugcuguauacaccccuucgcgccaacaacgcuggcgaugacguuuucaccguguccugcagagugcugacccggccuagcccggauuuugacuucauuuuucucgugcccccuacagucgaaucucgcaccaagcccuucuccguuccugugcugacggucgaggaaaugaccaauagcagauuucccaucccgcuugagaaacuguucacagggccuucuuccgccuucgugguucagccccagaacggacgguguaccacagauggcgugcuccuggggaccacgcaacugagcccugucaauauuugcacauuucgcggagacgugacccauauccccggcucuagaaacuacacaaugaaucucgccucccagaacuggaauagcuaugauccuaccgaggaaauccccgcuccgcugggcaccccugacuucgucgggaagauucagggagugcuuacacagacgacccggacaaacggcuccacccgcgggcacaaggcgacaguuuacaccggaucugccgacuuuagccccaaacugggcagagugcaauucgcuacggauacagacaaugauuuugagaccaaccagaauaccaaguucacacccgucggggugauccaggacggauccaccacaccucggaacgaaccgcaacaguggguucuccccagcuacucuggccgcaauauucauaacgugcaccuggccccugccgucgcucccacguuuccuggcgagcagcuucuguucuuuagauccaccaugcccggguguagcggauauccuaauauggaucucgacugccugcugccccaggaaugggugcaauacuucuaucaggaggccgcgccggcucagucugauguggcccuccugcgguuuguuaacccugacacaggcagaguccuuuucgaguguaaacugcacaagagcggguacgugaccguggcccauacaggacagcacgaucucgucauucccccuaacggcuauuuucgcuucgacuccugggugaaucaauucuacacccuggcucccauggggaacggcacgggaucucggagauga

SEQ ID NO: 30103 - RNA, 1617 nt, Artificial Sequence
  derived and/or modified sequence opt5 from VP1__Norovirus_and/or_Norovirus-like__JQ613548
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcagaaacuacaccaugaaucucgccucccagaacuggaacucuuaugauccugcugaggaaauccccgcgccucugggcacccccgacuucgucgggaaaauucagggagugcuuacacagacgacccggacaaauggcagcacccgcgggcacaaggccacaguuuacaccggauccgcugacuuuagcccgaagcugggcagagugcaauucgccacggauacagacaaugauuuugagaccaaccagaauaccaaauucacaccugucggggugauccaggacggaucuaccacaccccggaacgaaccccaacaguggguucucccuuccuacagcggccgcaauauucauaacgugcaccuggccccggcugucgcccccacguuuccuggcgagcagcuucuguucuuuagaucuaccaugcccggguguagcggauauccuaauauggaucucgacugccugcugccccaggaaugggugcaauacuucuaucaggaggcggcuccugcccaguccgauguggcccuccugcgguuuguuaaccccgacacaggcagaguccuuuucgaguguaagcugcacaaaucuggguacgugaccguggcucauacaggacagcacgaucucgucaucccgccuaacggcuauuuucgcuucgacagcugggugaaucaauucuacacccuggcccccauggggaacggcacgggacggagacgcuga

SEQ ID NO: 30104 - RNA, 1617 nt, Artificial Sequence
  derived and/or modified sequence opt5 from VP1__Norovirus_and/or_Norovirus-like__JN595867
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaacacccgcuccgcugggcacgccugacuucgucgggaaaauccagggagugcuuacccagacaacccggacaaacggcuccacccgcgggcacaaggcgacgguuuacacaggaucugccgacuuuagccccaagcugggcagagugcaauucgcuaccgauaccgacaaugauuuugagacaaaccagaauaccaaauucacacccgucggggugauucaggacggauccacgaccccucggaacgaaccgcaacaguggguucuccccagcuacucuggccgcaauauccauaacgugcaccuggccccugccgucgcucccacauuuccuggcgagcagcuucuguucuuuagauccaccaugcccggguguagcggauauccuaauauggaucucgacugccugcugccccaggaaugggugcaauacuucuaucaggaggccgcgccggcucagucugauguggcccuccugcgguuuguuaacccugacacaggcagaguccuuuucgaguguaagcugcacaaaagcggguacgugaccguggcccauacgggacagcacgaucucgucauucccccuaacggcuauuuucgcuucgacuccugggugaaucaauucuacacccuggcucccauggggaacggcacaggacggagacgcuga

SEQ ID NO: 30105 - RNA, 1617 nt, Artificial Sequence
  derived and/or modified sequence opt5 from VP1__Norovirus_and/or_Norovirus-like__AB629944
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauacccauaacgugcaccuggcccccgccgucgcuccuacauuucccggcgagcagcuucuguucuuuagaagcaccaugccuggguguucuggauaucccaauauggaucucgacugccugcugccucaggaaugggugcaauacuucuaucaggaggccgcgcccgcucagagcgauguggcccuccugcgguuuguuaacccggacacaggcagaguccuuuucgaguguaagcugcacaaauccucuuacgugaccguggcccauacggggcagcacgaucucgucauuccucccaacggauauuuucgcuucgacagcugggugaaucaauucuacacccuggcuccuaugggcaacgggacaggccggagacauuga

SEQ ID NO: 30106 - RNA, 1617 nt, Artificial Sequence
  derived and/or modified sequence opt5 from VP1__Norovirus_and/or_Norovirus-like__AB541192
augaagauggccagcuccgacgcuaaucccccugauggcucugccgcgaaccuggugccggaggucaacaaugaaguuauggcucucgagcccguggugggggccgccaucgcugccccugucgcuggacagcaaaacgugauugaccccuggaucagaaauaacuucguucaggccccuggcggggaauuuaccgugagcccccggaaugcgccuggagagauucugugguccgccccgcuuggccccgaucugaacccuuaccucucucaccuggcucgcauguauaauggguacgccggaggcuucgaaguccaggugauccuugcuggcaacgccuuuacagcggggaaaauuaucuucgccgcuguucccccuaauuuucccacggagggacugagcccgucccaggugaccauguucccucauaucauugucgacgugagacaacucgagcccgugcugaucccucugcccgauguccggaacaauuuuuaucacuacaaccagucuaaugacagcacaauuaagcucaucgccaugcuguauacaccccuucgcgcuaacaacgccggcgaagauguuuucaccguguccugcagagugcugacccggccuagcccggacuuugauuucauuuuucucgugcccccuacagucgagucucgcaccaaacccuucacgguuccuauccugaccguggaagagaugacaaauuccagauuucccauuccgcuugagaagcuguucaccgggccuagcggagccuucgucgugcagccccagaacggccgguguacaaccgacgggguucuccugggaacgacacaacugucuccugugaauaucugcaccuuucgcggcgaugcuacacauaucgcgggcuccagaagcuacaccaugaaccucgccucucugaauuggaacaauuaugaccccaccgaagagauuccugcuccccuugggacaccggauuucgucggaaaaauccagggcaugcugacgcagaccacaaagggggacggauccacccggggccacaaggccacaguguacaccgggagcgccccuuuuacgcccaaacucggauccguccaguucucuacagacaccgaaaacgauuuucaaacccaucagaauacaaaguucacccccgugggcguuauucaggacggcagcacaacgcaccgcaacgagccucaacagugggugcugccguccuacagcgggagagauguccacaaugugcaucuugcucccgccguugcgccuaccuuucccggagaacagcuccuguucuuucggucuacaaugccuggcuguuccggguaucccaacauggaccuggauugccugcucccucaggagugggugcaacacuucuaccaggaggcugcccccgcccagagcgacgucgcucugcuucgcuuugugaauccggauaccggaagagugcuguucgaauguaaacuccauaagucuggcuauguuacagucgcccacaccgggcagcacgaccuggugaucccucccaacggcuacuuucgguucgauagcugggugaaucaauucuauacgcuugcuccuaugggaaacggcaccgggagacgccgguga

SEQ ID NO: 30107 - RNA, 1617 nt, Artificial Sequence
  derived and/or modified sequence opt5 from VP1__Norovirus_and/or_Norovirus-like__AB504314
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggcgcauccagggaaugcuuacacagaccacaaaaggcgacggguccaccagaggacacaaggcgacggucagcacaggcuccguggauuuuaccccuaagcuggggucuguucaauucgccaccgacacagauaacgacuuugagaccggacagaauacacgguucacgcccgugggcgucauucaggauggcagcuccgcucuccgcaacgaaccccaacagugggugcugccugacuacagcgggagaaccguucauaaugugcaccuugccccggccgucgcucugacauuucccggagagcagcuccuguucuuucggucuaccaugccuggcuguuccggguaccccaacauggaucuggacugccuccugccucaggaaugggugcaacacuucuaucaggaggccgcgcccagccagucugauguggcccuucugagauuuguuaauccugacacaggacgcguccucuucgaguguaaacugcaucgggcuggcuacgugaccguggcccacacggggcagcaugaucuugucauucccccgaacggcuauuuuagauucgacagcugggugaaucaauucuacacccuggcuccuaugggaaacggcgccgggcgccggagauga

SEQ ID NO: 30108 - RNA, 1617 nt, Artificial Sequence
  derived and/or modified sequence opt5 from VP1__Norovirus_and/or_Norovirus-like__KX514350
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaguccggcaauaccaaaaucuacacaaugaaccucgcuagccccaauuggaacaauuaugacccuaccgaggagauccccgcgccucugggcacccccgacuucgucgggaagauucagggaaugcuuacacagacgaccaagggcgaaggguccacaagaggacaucgggccaccguguacguuggcucugcuaacuacgccccgaaacuggggcgcgugcaauuugagacagauaccacggacgaucucgacgcccaccagaauacaaaguucaccccugucggagugguucagagcggcgaaucccccaaaggcagcgagccccaacagugggugcugccuucuuauuccgggagagauaccccgaacguccaucuugcucccgccguggcgccuacauuucccggagaacagcuccuguucuuucggagcaccaucccuggcugugggggacaccccaauaugaaccuggacugccugcucccucaggagugggugcaacacuucuaccaggaggcugcccccgcccagucugauguugcucugcuucgcuuugucaauccggacacaagcagagugcuguucgaauguaagcuccauaaauccggcuaugugacggucgcccacaccgggcagcaugaucuggugauuccucccaacggcuacuuucgguucgacucuuggguuaaccaauuuuauacacuugcuccuaugggaaauggcaccgggagaaagcgcuga

SEQ ID NO: 30109 - RNA, 1617 nt, Artificial Sequence
  derived and/or modified sequence opt5 from VP1__Norovirus_and/or_Norovirus-like__KX514342
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaguccggcaauaccaaaaucuacacaaugaaccucgcuagccccaauuggaacaauuaugacccuaccgaggagauccccgcgccucugggcacccccgacuucgucgggaagauucagggaaugcuuacacagacgaccaagggcgaaggguccacaagaggacaucgggccaccguguacguuggcucugcuaacuacgccccgaaacuggggcgcgugcaauuugagacagauaccacggacgaucucgacgcccaccagaauacaaaguucaccccugucggagugguucagagcggcgaaucccccaaaggcagcgagccccaacagugggugcugccuucuuauuccgggagagauaccccgaacguccaucuugcucccgccguggcgccuacauuucccggagaacagcuccuguucuuucggagcaccaucccuggcugugggggacaccccaauauggaccuggauugccugcucccucaggagugggugcaacacuucuaccaggaggcugcccccgcccagucugacguugcucugcuucgcuuugucaacccggauacaagcagagugcuguucgaauguaagcuccauaaauccggcuaugugacggucgcccacaccgggcagcaugaccuggugauuccucccaauggcuacuuucgguucgauucuuggguuaaccaauuuuauacacuugcuccuaugggaaacggcaccgggagaaagcgcuga

SEQ ID NO: 30110 - RNA, 1617 nt, Artificial Sequence
  derived and/or modified sequence opt5 from VP1__Norovirus_and/or_Norovirus-like__KX514280
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaaggacagcaccauuaaacucaucgcuaugcuguauacaccccuucgcgccaacaacgcuggcgaugacguuuucaccguguccugcagagugcugacacggcccagcccugauuuugacuucauuuuucucgucccgcccaccguggaaucucgcuccaagccuuucagcguucccgugcugacggucgaggaaaugaccaauucuagauuuccugugacacuugauaaacuguucaccgggcccuccagcacaaucguugugcagccgcagaacggacgguguaccauugacggcguccuccuggggacgacacaacugucuccugugaauaucugcaccuuccgcggagaugucacacaucccagagacuccaccaucuacaccaugaaccucgccagcccuaauuggaacacauaugaccccacggaggagauuccugcuccccugggcaccccggauuuugugggcaagauccaggggaugcuuacacagaccacaaagggagccggcuccacccgggggcaccgcgcgacgguuuacgugggaucugccaauuacgcuccuaaacugggcagaguccaguucgaaacaaacaccagcgacgaucucgacgcccaucaaaauaccaaguuuacacccguggggguuauucagggaggcgaguccgcccaccggagcgaaccccagcaaugggugcugccuucuuauuccggccgcgauaucccgaacguccaccuugcucccgccguggcgccuaccuuccccggggagcagcugcucuuuuucagaagcacaauuccuggauguggcgggcaucccaauauggaccuggauugccugcucccucaggaaugggugcagcacuuuuaccaagaggcugcccccgcccagucugacguugcucugcuucgguucgucaacccggauacgagcagagugcuguuugaguguaaacuccauaaguccggauaugugaccgucgcccacacaggccagcacgaccuggugaucccucccaauggguacuuccgcuuugauucuuggguuaaccaguucuauacccuugcuccuaugggcaauggaacaggccggaaaagauga

SEQ ID NO: 30111 - RNA, 1617 nt, Artificial Sequence
  derived and/or modified sequence opt5 from VP1__Norovirus_and/or_Norovirus-like__LC177654
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucaucccucccaacggcuauuuucgcuucgacucuugggugaaucaauucuacacgcuggcuccuauggggaacggcaccggacggagacgcuga

SEQ ID NO: 30112 - RNA, 1617 nt, Artificial Sequence
  derived and/or modified sequence opt5 from VP1__Norovirus_and/or_Norovirus-like__KX354026
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaauuccugcuccccugggcacaccggacuucguggggaaaauccagggaguccuuacgcagaccacaucuaccaauggcagcacaagagggcauaaggcgaccguguacacgggauccgccgacuuuagcccuaagcugggccggguucaauucgcuacagauaccaauaacgacuuugagaccaaucagaacacaaaauucacccccgugggggucauucaggauggaucuacaacgccccgcaaugaaccucaacagugggugcucccguccuacagcggcagaaacauccacaauguucaccuggcccccgccguggcuccuaccuuucccggcgagcagcuucuguucuuucggucuacaaugccuggguguagcggauaucccaacauggaccucgauugccugcugccucaggaauggguccaauacuucuaucaggaggccgcgcccgcucaguccgacguggcccuccugcgcuuugugaacccggauaccggcagaguucuuuucgaguguaagcugcauaaaucuggguacgucacaguggcccacaccggacagcaugaccucgugauuccucccaauggcuauuuucgguucgauagcugggucaaccaauucuacacgcuggcuccuauggggaauggcaccggaagacgccgguga

SEQ ID NO: 30113 - RNA, 1617 nt, Artificial Sequence
  derived and/or modified sequence opt5 from VP1__Norovirus_and/or_Norovirus-like__KR904218
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgagaaucauugucgacgugcggcaacucgagccugugcugaucccccugccugauguccgcaacaauuuuuaucauuacaaccagagcaaugaccccaccauuaagcucaucgcuaugcuguauacaccccuuagagccaacaacgcuggcgaugacguuuucaccguguccugccgggugcugacacgcccuagcccggauuuugacuucauuuuucucgugcccccuaccgucgaaucuagaacgaaacccuucuccguuccuauccugaccguggaggaaaugacaaauagccgguuucccauuccgcuugagaagcuguucaccgggccuucuuccgccuucgucgugcagccccagaacggacgcuguagcacagauggcguucuccuggggaccacgcaacugucuccugugaauaucugcacauuuagaggagacgucacccacaucgccggcucccauaacuacacaaugaaucucgcuagccagaacugguccucuuaugaucccaccgaggaaauuccugcgccccugggcaccccggacuucguggggaaaauccagggaguccuuacacagacgacccggacagacggcagcacccgcgggcacaaggccacaguguacaccggauccgcugauuuuagcccuaagcugggcagaguucaauucgccacggacacaaauaacgauuuugagucuaaucagaacaccaaauucgcccccgugggggucauucaggacggaggcaccgcucaucggaaugaaccccaacagugggugcucccuuccuacagcggccgcaacauccacaauguucaccuggccccggcgguggcucccacauuuccuggggagcagcuucuguucuuuagaucuaccauucccggauguagcggcuauccuaacauggaucucgacugccugcugccccaggaauggguccaauacuucuaucaggaggccgccccugcucaguccgauguggcccuccugcgguuugugaaucccgacacagggagaguucuuuucgaguguaagcugcauaaaucuggauacgucacgguggcucacaccggccagcaugaucucgugaucccgccuaacggguauuuucgcuucgacagcugggucaaccaauucuacacacuggcccccaugggcaauggaaccggccggagacgcuga

SEQ ID NO: 30114 - RNA, 1617 nt, Artificial Sequence
  derived and/or modified sequence opt5 from VP1__Norovirus_and/or_Norovirus-like__KJ678150
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuacaccccuugagaagcuguucaccgggccguccagcgccuucgugguccagccucagaacggacgguguacaaccgauggcgugcuccuggggacgacacaacugucucccgucaauaucugcaccuuucgcggagacgugacacauauuaccggcuccagaaacuacaccaugaaucucgcuagccagaacugguccaauuaugauccuacagaggaaauccccgcgccucugggcacgcccgacuucguugggaaaauucagggagugcuuacccagacaacccggacagacggcucuacccgcgggcacaaggccacggucuacacaggaagcgcugauuuugccccgaagcugggcagagugcaauucgagaccgacaccgaucaugacuuugaaacaaaccagaauaccaaauucacaccuguuggggugauccaggauggauccacgacccaccggaacgagccccaacaguggguccuccccagcuacucuggccgcaauacaccuaacgugcaccuggccccggcuguggcccccaccuuuccuggcgaacagcuucuguucuuuagauccacaaugcccggguguagcggauauccuaauauggaccucgauugccugcugccccaggaguggguucaauacuucuaucaggaggcggcuccugcccagucugacgucgcccuccugcgguuugugaaccccgauaccggcagagugcuuuucgaauguaagcugcauaaaagcggguacgucacgguggcucacaccggacagcaugaccucguuaucccgccuaauggcuauuuucgcuucgauuccugggugaaccaauucuacacacuggcccccauggggaacggcaccggacggagacgcuga

SEQ ID NO: 30115 - RNA, 1617 nt, Artificial Sequence
  derived and/or modified sequence opt5 from VP1__Norovirus_and/or_Norovirus-like__KJ678148
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuacaccccuugagaagcuguucaccgggccguccagcgccuucgugguccagccucagaacggacgguguacaaccgauggcgugcuccuggggacgacacaacugucucccgucaauaucugcaccuuucgcggagacgugacacauauuaccggcuccagaaacuacaccaugaaucucgcuagccagaacugguccaauuaugauccuacagaggaaauccccgcgccucugggcacgcccgacuucguugggaaaauucagggagugcuuacccagacaacccggacagacggcucuacccgcgggcacaaggccacggucuacacaggaagcgcugauuuugccccgaagcugggcagagugcaauucgagaccgacaccgaucaugacuuugaaacaaaccagaauaccaaauucacaccuguuggggugauccaggauggauccacgacccaccggaacgagccccaacaguggguccuccccagcuacucuggccgcaauacaccuaacgugcaccuggccccggcuguggcccccaccuuuccuggcgaacagcuucuguucuuuagauccacaauccccggguguagcggauauccuaauauggaccucgauugccugcugccccaggaguggguucaauacuucuaucaggaggcggcuccugcccagucugacgucgcccuccugcgguuugugaaccccgauaccggcagagugcuuuucgaauguaagcugcauaaaagcggguacgucacgguggcucacaccggacagcaugaccucguuauuccgccuaauggcuauuuucgcuucgauuccugggugaaccaauucuacacacuggcccccauggggaacggcaccggacggagacgcuga

SEQ ID NO: 30116 - RNA, 1617 nt, Artificial Sequence
  derived and/or modified sequence opt5 from VP1__Norovirus_and/or_Norovirus-like__KP244316
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauaucuccggcagcagaaauuacaccaugaaccucgccucccagaauuggaacucuuaugaucccaccgaggaaaucccugcuccccugggcacaccggacuucgucgggaaaacgcagggagugcuuacccagacaaccaagacaaauggcagcacccgggggcacaaggcgacgguuuacacaggauccgccgacuuuagcccuaaacugggccgcgugcaauucgcuaccgauaccgacaacgauuuugagacaaaucagaacaccaaguucacacccgucggggugauucaggacggaucuacgacccccagagaugaaccucaacaguggguucucccguccuacagcggccggaauacacauaacgugcaccuggcccccgccgucgcuccuaccuuucccggcgagcagcuucuguucuuucgcucuacaaugccuggguguagcggauaucccaauauggaccucgauagacugcugccucaggaaugggugcaauacuucuaucaggagcccgccccggcgcaguccgacguggcucuccugcgguuuguuaacccugauaccggcagaguccuuuucgagugcaaacugcacaagucuggguacgugacgguggcccauaccggacagcacgaccucgucauucccccuaauggcuauuuucgcuucgauagcugggugaaccaauucuacacacuggcccccauggggaacggcaccggacggagacgcuga

SEQ ID NO: 30117 - RNA, 1617 nt, Artificial Sequence
  derived and/or modified sequence opt5 from VP1__Norovirus_and/or_Norovirus-like__KF060072
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucuccggcagcagaaacuacacaaugaaucucgcuucccagaacuggaacucuuaugauccuaccgaggaaauccccgcgccucugggcacccccgacuucgucgggaaaauucagggagugcuuacacagacgacccggacagacggcagcacccgcgggcacaaggccacaguuuacaccggauccgcugauuuuagcccgaagcugggcagagugcaauucgccacggacacagauaaugacuuuaucaccaaucagaacaccaaauucacaccugucggggugauucaggauggaucuaccacaccccggaaugagccccaacaguggguucucccuuccuacagcggccgcaacacgcauaaugugcaccuggccccggcugucgcccccaccuuuccuggcgaacagcuucuguucuuuagaucuacaaugcccggguguagcggauauccuaacauggaccucgauugccugcugccccaggagugggugcaauacuucuaucaggaagcggcuccugcccaguccgacguggcccuccugcgguuuguuaaucccgauaccggcagaguccuuuucgaguguaagcugcacaaaccgggguacgugacaguggcucauaccggacagcacgaccucgucaucccucccaacggcuauuuucgcuucgauucuugggugaaccaauucuacacgcuggccccuauggggaauggcaccggacggagacgcuga

SEQ ID NO: 30118 - RNA, 1617 nt, Artificial Sequence
  derived and/or modified sequence opt5 from VP1__Norovirus_and/or_Norovirus-like__JX439822
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaaagcggguacgugacaguggcccauaccggacagcacgaucucgucauucccccuaacggcuauuuucgcuucgacuccugggugaaucaauucuacacgcuggcucccauggggaacggcaccggaucucggagauga

SEQ ID NO: 30119 - RNA, 1617 nt, Artificial Sequence
  derived and/or modified sequence opt5 from VP1__Norovirus_and/or_Norovirus-like__KC463910
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaauuccugcuccccugggcacaccggacuucguggggaaaauccagggaguccuuacgcagaccacaucuaccaauggcagcacaagagggcauaaggcgaccguguacacgggauccgccgacuuuagcccuaagcugggccggguucaauucucuacagauaccaauaacgacuuugagaccaaucagaacacaaaauucacccccgugggggucauucaggauggauccacaacgccccgcaaugaaccucaacagugggugcucccgagcuacucuggcagaaacauccacaauguucaccuggcucccgccguggccccuaccuuucccggcgagcagcuucuguucuuucggagcacaaugccuggguguuccggauaucccaacauggaccucgauugccugcugccucaggaauggguccaauacuucuaucaggaggcugcccccgcgcagucugacguggcucuccugcgcuuugugaacccggauaccggcagaguucuuuucgaguguaagcugcauaaaagcggguacgucacaguggcccacaccggacagcaugaccucgugauuccucccaauggcuauuuucgguucgauuccugggucaaccaauucuacacgcuggccccuauggggaauggcaccggaagacgccgguga

SEQ ID NO: 30120 - RNA, 1617 nt, Artificial Sequence
  derived and/or modified sequence opt5 from VP1__Norovirus_and/or_Norovirus-like__JX459651
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuuucuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucaucccucccaacggcuauuuucgcuucgacucuugggugaaucaauucuacacgcuggcuccuauggggaacggcaccggacggagacgcuga

SEQ ID NO: 30121 - RNA, 1617 nt, Artificial Sequence
  derived and/or modified sequence opt5 from VP1__Norovirus_and/or_Norovirus-like__AB541314
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaaguuguguucaccgugagcugcagaguccugacccggcccucuccugauuuugacuucauuugucucgugccgcccacaguugagucccgcaccaaaccuuuuacggugcccauccugaccgucgaagagaugacaaauagcagauucccuauuccccuugagaagcuguuuaccgggccgucuuccgccuucgugguucagccucagaacggacggugcacaaccgauggcgugcuccuggggacgacacaacugagccccgucaauaucuguaccuuccgcggagacgugacacauaucgcuggcucuagaaacuacaccaugaaucucgcgucccugaacuggaauaacuaugauccuaccgaagagauucccgccccucuuggcacacccgacuuugucgggaaaauccagggagugcugacgcagaccacaaagggcgaugggagcacccggggacacaaggcuacaguuuacaccggcuccgccccguucacgccuaaacucgggucugugcaguuuagcacagacaccgaaaaugacuucgagacccaucaaaacacaaaguuuacccccgucggagugauucaggauggcggcacaacgcaccgcaaugaaccccagcaauggguucugccuuccuacagcgggagaaacgugccgaauguccaccuugcccccgcuguggccccuaccuuccccggagagcagcugcucuuuuuccggucuacaaugccuggcugcuccggguaucccaacauggaccuggauugucugcucccucaggagugggugcagcauuuuuaccaagaagcggcucccgcccagagcgacguugcccugcuucgcuucgucaauccggauaccggaagagugcuguuugagugcaaacuccacaagccuggcuaugugacagucgcucauaccgggcagcacgaccuggugauccccucuaacggcuacuuccgguuugauagcuggguuaaccaguucuauacgcuugccccuaugggaaauggcaccgggagacgccgguga

SEQ ID NO: 30122 - RNA, 1617 nt, Artificial Sequence
  derived and/or modified sequence opt5 from VP1__Norovirus_and/or_Norovirus-like__AB504323
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauuaucgacgucagacaacucgagccugugcugauuccccugccugaugugcggaacaauuuuuaucacuacaaccagagcaaugacuccacaaucaagcucauugccaugcuguauacaccccuucgcgcuaacaacgccggcgaagaugucuucaccguuagcugcagagugcugacccggcccucucucgacuuugauuucaucuuucuggugccuccgacagucgagucccgcaccaaacccuucacggugccuauucuuaccguugaagagaugacaaauagcagauuucccaucccucuggagaaacucuucaccgggcccucuggagccuucgugguccagccgcagaacggccgguguacaaccgacggggugcugcugggaacgacacaacucuccccuguuaauaucugcacccugcgcggcgaugugacacauauugcuggcagcagaaacuacaccaugaaucuugcgucucugaacuggaauaacuaugaccccaccgaagagaucccugcuccccucgggacaccugauuuugucggaaagauucagggcgugcugacgcagaccacaaagggggacggauccacccggggccacaaggccacagucuacaccgggagcgcccccuucacgccgaaacuuggauccgugcaguuuucuacagacaccgaaaaugauuucgagacccaucaaaacacaaaguuuaccccuguuggcgugauccaggacggcagcacaacgcaccgcaaugaaccccagcaauggguccugcccuccuacagcgggagaaacgugcacaauguucaucucgccccugcuguggccccgaccuuccccggagagcagcugcuguuuuuccggucuacaaugccuggcuguuccggguaucccaacauggaucucgacugccugcuuccucaggaguggguccagcacuuuuaccaagaagcggcucccgcccagagcgauguggcccugcuccgcuucgugaauccugacaccggaagaguucuguuugaguguaaacuucauaagucuggcuaugucacaguggcucacaccgggcagcacgaucuggugauucccccgaacggcuacuuccgguuugacagcugggucaaccaguucuauacgcucgccccuaugggaaauggcaccgggagacgccgguga

SEQ ID NO: 30123 - RNA, 1617 nt, Artificial Sequence
  derived and/or modified sequence opt5 from VP1__Norovirus_and/or_Norovirus-like__KX353963
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccaggacacaaaauucacccccgucggggugauccaggauggaagcacaacgccccggaaugaaccucaacaguggguucucccgucuuacuccggccgcaacauucauaaugugcaccuggcccccgccgucgcuccuaccuuucccggcgagcagcuucuguucuuuagaagcacaaugccuggguguucuggauaucccaacauggaccucgauugccugcugccucaggaaugggugcaauacuucuaucaggaggccgcgcccgcucagagcgacguggcccuccugcgguuuguuaauccggauaccggcagaguccuuuucgaguguaagcugcacaaauccggguacgugacaguggcccauaccggacagcacgaccucgucaucccucccaacggcuauuuucgcuucgauucuugggugaaccaauucuacacgcuggcuccuauggggaauggcaccggacggagacgcuga

SEQ ID NO: 30124 - RNA, 1617 nt, Artificial Sequence
  derived and/or modified sequence opt5 from VP1__Norovirus_and/or_Norovirus-like__KR904213
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucaucccucccaacggcuauuuucgcuucgacucuugggugaaucaauucuuuagccuggcuccuauggggaacggcacgggacggagacgcuga

SEQ ID NO: 30125 - RNA, 1617 nt, Artificial Sequence
  derived and/or modified sequence opt5 from VP1__Norovirus_and/or_Norovirus-like__AB933745
augaagauggccagcaaccacgugaaucccuccgacggcucuaccgcuaaccuggucccugagguuaauaacgaagugauggcccucgagccgguggucggggcggcuaucgccgcccccguggcuggacagcaaaauguuauugauccuuggaucagaaacaauuucgugcaggcccccggcggggaauuuacagucagcccucggaacgcucccggagagauucugugguccgccccucuuggcccggaccugaaucccuaccucucucaucuggcgcgcauguauaacggguacgccggaggcuucgaagugcagguuauccuugcuggcaaugccuuuacggcugggaaaauuaucuucgccgcggugccucccaacuuuccuaccgagggacugagccccucccaggucacaauguucccgcacaucauuguggaugugagacaacucgagccuguccugaucccccugccugacguucggaauaacuuuuaucauuacaaucagucuaacgaucccaccauuaagcucaucgccaugcuguauacaccccuucgcgcuaacaaugccggcgacgauguguucaccgugagcugcagaguccugacacggccuuccccggacuuugauuucauuuuucucgugcccccuaccguugaaagccgcacgaaacccuucucugugccuguccugaccguggaggaaaugacaaacuccagauuucccaucccgcuugagaagcuguucaccgggccuagcucugcuuucguugugcagccccagaauggacgguguacaaccgacggcguccuccuggggacgacacaacuguccccugugaacauuugcaccuuucgcggagaugucacacacauccccggcagcagaaauuacaccaugaaccucgccucucagaauuggaacuccuaugacccuaccgaggaaauccccgccccgcugggcacaccugauuucguggggaaaauucagggaguucuuacgcagaccacacggaccaauggcagcacacgcgggcauaaggcuaccguguacacgggauccgcggacuuuucucccaagcugggcagaguccaauucgccacagacaccgauaacgacuuugagaccaaucagaacacaaaauucacccccguggggguuauccaggauggaagcacaacgccucggaaugaaccgcaacagugggugcuccccuccuacagcggccgcaacauucacaauguccaccuggcuccugccguggcccccaccuuuccuggcgagcagcuucuguucuuuagaucuaucaugcccggguguuccggauauccuaacauggaccucgauugccugcugccccaggaaugggugcaauacuucuaucaggaggcugccccggcgcagagcgacguugcucuccugcgguuugucaacccugauacaggcagagugcuuuucgaguguaagcugcauaaaucuggguacgugaccgucgcccacacaggacagcaugaccucgugauucccccuaauggcuauuuucgcuucgauagcuggguuaaccaauucuacacccuggcccccauggggaauggcacgggacggagacgcuga

SEQ ID NO: 30126 - RNA, 1617 nt, Artificial Sequence
  derived and/or modified sequence opt5 from VP1__Norovirus_and/or_Norovirus-like__KP096341
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggaaugcuuacgcagaccacacggaccgacggcuccacacgcgggcacaaggccaccguguacaucggaggcgcugauuuugccccuaagcuggggagaguccaauucgagacggacacagaucaugacuuugaagccaaccagaauaccaaauucacccccgugggaguuauucaggauggcucuacaacccaccggaacgagccccaacagugggugcucccuagcuacuccggccgcaauacaccgaacguccaccuggcucccgccguggcgccuacguuucccggggaacagcuucuguucuuuagaagcaccaugccuggauguucuggcuaucccaauauggaccucgauugccugcugccucaggagugggugcaauacuucuaucaggaggcugcccccgcccaguccgacguugcucuccugcgguuugucaacccggauacagggagagugcuuuucgaauguaagcugcauaaaagcggauacgugaccgucgcccacacaggccagcaugaccucgugaucccucccaauggguauuuucgcuucgauucuuggguuaaccaauucuacacccuggcuccuaugggcaacggaacgggccggagacgcuga

SEQ ID NO: 30127 - RNA, 1617 nt, Artificial Sequence
  derived and/or modified sequence opt5 from VP1__Norovirus_and/or_Norovirus-like__KM114291
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucccgccccuggcggggaauuuaccgugucuccccggaaugcgccuggagagauucugugguccgccccgcuuggccccgaucugaacccuuaccucagccaccuggcucgcauguauaauggguacgccggaggcuucgaaguccaggugauccuugcuggcaacgccuuuacagcggggaaaguuauuuucgccgcugugcccccuaauuuucccacggagggacuguccccgucucaggucaccauguucccucauaucgugguggacgucagacagcucgagcccguucugaucccucugcccgaugugcggaacaauuuuuaucacuacaaccaaagcaaugaccccacaauuaagcucaucgccaugcuguauaccccucuucgcgcuaacaacgccggcgaugacguguucacagucuccugcagagugcugacccggccgagccccgauuuugacuucauuuuucucguuccucccacaguggaaucucgcaccaaaccuuucuccguccccgugcugacgguugaggaaaugaccaauagcagauuuccgaucccucuugagaagcuguucacagggcccucuuccgccuucgugguccagccucagaacggacgguguaccacagauggcgugcuccugggggcuacccagcugagccccgucaauauuugcacguuucgcggagacgugacacauaucaccggcucuagaaacuacacaaugaaucucgcgucccaaaacuggagcaauuaugauccuaccgaggaaauucccgccccgcugggcaccccugacuucguugggaaaauccagggagugcuuacacagacgacccggacagacggcuccacccgcgggcacaaggcuacagucuacaccggaucugccgauuuugcccccaagcugggcagagugcaguucgagacggacacagaucgggacuuugaagcuaaccaaaauaccaaauucacccccguuggggugauccaggauggaagcacaacccaucgcaacgagccucagcaauggguccucccguccuacagcggcagaaauacacccaacgugcaccuggccccugcgguggcucccacguuuccuggcgaacagcuucuguucuuucggucuaccaugcccggguguuccggauauccuaauauggaccucgauugccugcugccccaggaguggguucaguacuucuaucaagaggccgccccggcucagagcgacgucgcccuccugagauuugugaacccugauacaggccgcgugcuuuucgaauguaagcugcacaaaucuggguacgucaccguggcucauacaggacagcacgaccucguuauucccccuaauggcuauuuucgguucgauagcugggugaaccaguucuacacccuggcccccauggggaacggcacgggaagacgccgguga

SEQ ID NO: 30128 - RNA, 1617 nt, Artificial Sequence
  derived and/or modified sequence opt5 from VP1__Norovirus_and/or_Norovirus-like__KF060105
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaaugucugcaccuuucgcggagacgugacacauaucccuggcucccacaacuacaccaugaaucucgccagccagaacuggaacuccuaugaucccaccgaggaaaucccugcuccccugggcacaccggacuucgucgggaaaauucagggagugcuuacgcagaccacaucuaccaauggcagcacaagagggcauaaggcgaccguuuacacgggauccgccgacuuuagcccuaagcugggccgggugcaauucgcuacagauaccaauaacgacuuugagaccaaucagaacacaaaauucacccccgucggggugauccaggauggaucuacaacgccccgcaaugaaccucaacaguggguucucccguccuacagcggcagaaacauucacaaugugcaccuggcccccgccgucgcuccuaccuuucccggcgagcagcuucuguucuuucggucuacaaugccuggguguagcggauaucccaacauggaccucgauugccugcugccucaggaaugggugcaauacuucuaucaggaggccgcgcccgcucaguccgacguggcccuccugcgcuuuguuaacccggauaccggcagaguccuuuucgaguguaagcugcauaaaucuggguacgugacaguggcccacaccggacagcaugaccucgucaucccucccaauggcuauuuucgguucgauagcugggugaaccaauucuacacgcuggcuccuauggggaauggcaccggaagacgccgguga

SEQ ID NO: 30129 - RNA, 1617 nt, Artificial Sequence
  derived and/or modified sequence opt5 from VP1__Norovirus_and/or_Norovirus-like__KF060081
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcucccacaacuacaccaugaaucucgccagccagaacuggaacuccuaugaucccaccgaggaaaucccugcuccccugggcacaccggacuucgucgggaaaauucagggagugcuuacgcagaccacaucuaccaauggcagcacaagagggcauaaggcgaccguuuacacgggauccgccgacuuuagcccuaagcugggccgggugcaauucgcuacagauaccaauaacgacuuugagaccaaucagaacacaaaauucacccccgucggggugauccaggauggaucuacaacgccccgcaaugaaccucaacaguggguucucccguccuacagcggcagaaacauucacaaugugcaccuggcccccgccgucgcuccuaccuuucccggcgagcagcuucuguucuuucggucuacaaugccuggguguagcggauaucccaacauggaccucgauugccugcugccucaggaaugggugcaauacuucuaucaggaggccgcgcccgcucaguccgacguggcccuccugcgcuuuguuaacccggauaccggcagaguccuuuucgaguguaagcugcauaaaucuggguacgugacaguggcccacaccggacagcaugaccucgucaucccucccaauggcuauuuucgguucgauagcugggugaaccaauucuacacgcuggcuccuauggggaauggcaccggaagacgccgguga

SEQ ID NO: 30130 - RNA, 1617 nt, Artificial Sequence
  derived and/or modified sequence opt5 from VP1__Norovirus_and/or_Norovirus-like__KF059999
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggagaccgcuccugcccagucugacgucgcccuccugcgguuugugaaucccgauacagggagagugcuuuucgaauguaagcugcacaaauccugcuacgucaccguggcucauacgggacagcacgaccucguuauuccgccuaacggcuauuuucgcuucgauagcugggugaaccaauucuacacccuggcccccauggggaauggcacaggacggagacgcuga

SEQ ID NO: 30131 - RNA, 1617 nt, Artificial Sequence
  derived and/or modified sequence opt5 from VP1__Norovirus_and/or_Norovirus-like__JX644036
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccaacgccuucgugguucagccucagaauggacgguguacaaccgauggcgugcuccuggggacgacacaacugagccccgucaacauuugcaccuuucgcggagacgugacacauaucccuggcucuagaaauuacaccaugaaccucgccucccagaauuggaacagcuaugaucccaccgaggaaaucccugcuccccugggcacaccggacuucgucgggaaaauucagggagugcuuacgcagaccacacggaccaauggcuccacacgcgggcacaaggcgaccguuuacacgggaucugccgacuuuagcccuaagcugggcagagugcaauucgcuacagauaccgacaacgauuuugagaccaaucagaacacaaaauucacccccgucggggugauccaggacggauccacaacgccccggaaugaaccucaacaguggguucucccgagcuacucuggccgcaacauucauaaugugcaccuggcccccgccgucgcuccuaccuuucccggcgagcagcuucuguucuuuagauccacaaugccuggguguagcggauaucccaacauggaucucgacugccugcugccucaggaaugggugcaauacuucuaucaggaggccgcgcccgcucagucugauguggcccuccugcgguuuguuaacccggacaccggcagaguccuuuucgaguguaagcugcacaaaagcggguacgugacaguggcccauaccggacagcacgaucucgucaucccucccaauggcuauuuucgcuucgacuccugggugaaccaauucuacacgcuggcuccuauggggaauggcaccggacggagacgcuga

SEQ ID NO: 30132 - RNA, 1617 nt, Artificial Sequence
  derived and/or modified sequence opt5 from VP1__Norovirus_and/or_Norovirus-like__JX459654
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuucccucgauuuugacuucauuuuucuggucccgcccaccguggaaagccgcacgaaaccuuucucuguucccgugcuuaccgucgaggaaaugacaaacuccagauuuccuaucccccuggagaagcuguucaccgggccgagcucugccuucgugguucagccucagaauggacgguguacaaccgauggcgugcugcuggggacgacacaacucucccccgucaacauuugcaccuuucgcggagacgugauccauaucccuggcagcagaaauuacacaaugaaccuggccucucagaauuggaacuccuaugaucccaccgaggaaauuccugcuccccuuggcaccccggacuucgucgggaaaauccagggagugcugacacagacgacccggacaaauggcagcacccgcgggcacaaggcgacaguuuacaccggauccgccgacuuuucuccuaagcucggcagagugcaauucgcuacggauacagacaacgauuuugagaccaaucagaacaccaaauucacacccgucggggugauucaggacggaagcaccacaccccggaaugaaccucaacaguggguucugccguccuacagcggccgcaacauccauaaugugcaccuugcccccgccgucgcuccuacguuucccggcgagcagcuccucuucuuuagaucuaccaugccuggguguuccggauaucccaacauggaucuggacugccugcucccucaggaaugggugcaauacuucuaucaggaggccgcgcccgcucagagcgauguggcccugcuucgguuuguuaacccggacacaggcagaguccuguucgaguguaagcuccacaaaucuggguacgugaccguggcccauacaggacagcacgaucuggucauuccucccaauggcuauuuucgcuucgacagcugggugaaccaauucuacacccuugcuccuauggggaauggcacgggacggagacgcuga

SEQ ID NO: 30133 - RNA, 1617 nt, Artificial Sequence
  derived and/or modified sequence opt5 from VP1__Norovirus_and/or_Norovirus-like__JN400621
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagagucauguucgaguguaaacuucacaaguccggguacgugacaguggcccauaccggacagcacgaucuggucaucccucccaacggcuauuuucgcuucgacucuugggugaaucaauucuacacgcucgcuccuauggggaacggcaccggacggagacgcuga

SEQ ID NO: 30134 - RNA, 1617 nt, Artificial Sequence
  derived and/or modified sequence opt5 from VP1__Norovirus_and/or_Norovirus-like__AB541260
augaagauggccagcaacgacgcuaaucccuccgauggcucugccgcgaaccuggugccugaggucaauaacgaaguuauggcucucgagccgguggugggggccgccaucgcugcccccgucgcugcccagcaaaaugugauugacccuuggaucagaaacaauuucguucaggcgcccggaggcgaauuuaccgugagcccucggaacgcccccuccgagauucuguggucugcuccucuugggccggaucugaaucccuaccucagccacuucgcccgcauguauaacugcuacgcuggaggcuuugaaguccaggugauccuggccgggaaugcguucacagccggaaaaauuaucuuugcugccguuccucccaacuucccuacggagggccuuucccccucucaggugaccauguuuccgcauaucauugucgacgugagacaacuggagccugugcucaucccccugccugauguccggaauaacuucuaucacuacaaucagagcaacgacuccacaauuaagcugaucgcuaugcucuauacaccccugcgcgccaacaaugccggcgaagauguuuuuaccgugagcuguagagugcuuacccggcccucuccugacuucgauuuuauuuuccuggucccgcccacaguggagucccgcaccaaaccuuuuacgguucccauccucaccguggaagagaugacaaacagcagauucccuauuccccuggagaaacuuuucaccgggccgucuuccgcuuuugucgugcagccucagaauggacggugcacaaccgacggcguucugcucgggacgacacaacugagccccgugaacaucuguaccuuccgcggagaugucacacauaucgcgggcucuagaaauuacaccaugaaccuggccucccucaauuggaacaauuaugacccuaccgaagagauucccgcuccucuggggacacccgauuuugugggaaagauccagggcguccuuacgcagaccacaaagggcgacgggagcacccggggacacaaggccacaguguacaccggcuccgccccguucacgccuaaacuggggucuguucaguuuagcacagacaccgaaaacgauuucgagacccaucaaaauacaaaguuuacccccgugggagucauucaggacggcgggacaacgcaccgcaacgaaccccagcaaugggugcucccuuccuacagcggaagaaauguuccgaacgugcaccuggcucccgccgucgcgccuaccuuccccggcgagcagcuucuguuuuuccggucuacaaugccuggcugcuccggguaucccaauauggaucucgacugucugcugccucaggagugggugcagcauuuuuaccaagaagcugcccccgcccagagcgauguggcucuccugcgcuucguuaacccggacaccggaagaguccuuuuugagugcaaacugcacaagucuggcuaugugacaguggcccauaccgggcagcacgaucucgucaucccucccaacggauacuuccgguucgacagcugggugaaucaguuuuauacgcuggcuccuaugggcaacgggaccggcagacgccgguga

SEQ ID NO: 30135 - RNA, 1617 nt, Artificial Sequence
  derived and/or modified sequence opt5 from VP1__Norovirus_and/or_Norovirus-like__KX514341
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaacgccggcgaugacguuuucaccguguccugcagagugcugacacggcccagcccugauuuugacuucauuuuucucgucccgcccaccguggaaucucgcuccaaaccuuucagcguucccgugcugacggucgaggaaaugaccaauucuagauuuccugccacacuugauaagcuguucaccgggcccuccagcacauucgugguucagccgcagaacggacgguguaugaucgacggcgugcuccuggggaccacgcaacugucuccugucaauauuugcacauuucgcggagaugugacccaguccggcaacacaaaaaucuacaccaugaaucucgcuagccccaacuggaauaacuaugacccuaccgaggagauccccgcgccucugggcacacccgacuucgucgggaagauucagggaaugcuuacgcagaccacaaagggcgaaggguccaccagaggacaucgggccacaguguacguuggcucugcuaauuacgccccgaaacuggggcgcgugcaauuugagaccgauacgacagacgaucucgacgcccaccagaacaccaaguucaccccugucggagugguucagagcggcgaaucccccaaaggcagcgagccccaacagugggugcugccuucuuauuccgggagagauacaccgaauguccaucuugcucccgccguggcgccuaccuuucccggagaacagcuccuguucuuucggagcacaaucccuggcugugggggacaccccaacaugaaucuggacugccugcucccucaggagugggugcaacacuucuaccaggaggcugcccccgcccagucugauguugcucugcuucgcuuugucaacccggacacgagcagagugcuguucgaauguaagcuccauaaauccggcuaugugaccgucgcccacacagggcagcaugaucuggugauuccucccaauggcuacuuucgguucgacucuuggguuaaccaauuuuauacccuugcuccuaugggaaacggcacagggagaaagcgcuga

SEQ ID NO: 30136 - RNA, 1617 nt, Artificial Sequence
  derived and/or modified sequence opt5 from VP1__Norovirus_and/or_Norovirus-like__KX514253
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggggcugaaucccuaccucucucaccuggcccgcauguauaacggauacgcuggcggcuucgaaguccaggugauccuugccgggaaugcuuuuacggccggaaaaauuaucuucgcggccguuccucccaacuuuccuaccgagggccugaaucccagccaggugacaauguucccgcauaucauugucgaugugagacaacucgagccugugcugaucccccugccugacguccggaacaauuuuuaucacuacaaccaguccaacgauucuaccauuaagcucaucgcuaugcuguauacaccccuucgcgccaauaacgcuggggacgauguuuucaccgugagcugcagagugcugacacggcccuccccugacuuugauuucauuuuucucgucccgcccaccguggaaagccgcucuaaaccuuucuccguucccgugcugacgguccaggagaugaccaauagcagauuuccugccacacuugacaagcuguucaccggacccucuuccaaccucgugguucagccgcaaaauggccgguguaugaucgauggggugcugcugggaacaacccagcucagcccugucaacauuugcacguuccgcggcgacgugacacaucugagagauucuaccaucuacacaaugaaucuugccucccccaacuggaauaacuaugacccuaccgaagagauccccgcuccucugggcacccccgacuuugucgggaaaauucagggagugcucacacagacgaccaagggcgaggggagcacacggggacaccgcgcgaccguuuacgugggcuccgccgauuacacaccgaagcuggggaaaguccaauucgaaaccaauacgacaaacgaccuuuaugcucaucagaauaccaaguuuaccccugugggaguugugcagggcggcgagucugcccacagaagcgaaccccaacaguggguccugcccggguacuccggacgggauacaccuaacgugcaccucgccccggcuguggcccccaccuucccuggcgagcagcugcuguuuuuccgcagcacaauccccggguguggaggccauccuaauauggaccucgauugccugcuuccccaggaauggguucaacacuuuuaucaggaggcggcuccugcccagucugacgucgcccugcucagauucgugaaccccgauacgucccgggugcuguuugaguguaaacuucauaagagcggguacgucaccguggcucacacaggccagcacgaccugguuauuccgccuaacggauauuucagauuugauucuugggugaaucaauucuacacccucgcccccaugggcaacgggacaggacgcaaacgguga

SEQ ID NO: 30137 - RNA, 1617 nt, Artificial Sequence
  derived and/or modified sequence opt5 from VP1__Norovirus_and/or_Norovirus-like__KX514195
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauuccuacgccgggggauucgaaguccaggugauccuugcuggcaacgccuuuacagcgggcaaaauuaucuucgccgcuguuccucccacguuuccuaccgaggggcugucucccagccaggugacaauguucccgcauaucauugucgacgugagacaacucgagccugugcugaucccccugccugauguccggaauaacuuuuaucacuacaaucaguccaacgacagcaccauuaagcucaucgccaugcuguauacaccccuucgcgcuaauaaccccggagaugacguuuucaccgugucuugcagagugcugacacggccuuccccggauuuugacuucauuuuucucgugcccccuaccgucgaaagccgcacgaaacccuucucuguuccuauccugaccgugggcgagaugacaaacuccagauuucccauuaaucuugaacggcuguucaccgggccgagcucuacacucgucgugcagccucagaacggacgcuguaugaucgauggcguucugcuggggaccacgcaacucucccccgugaauaucugcacauucagaggagacgucacccauagccgggauuccacaauuuacaccaugaaccuggccucuccuaauuggaacaauuaugaccccaccgaggagaucccugcuccccuuggcacaccggacuuugugggcaagauucaggggguccugacgcagaccacaaaaggagaaggcagcacccgcgggcacagagccacaguguacguuggauccgcgaacuacaccccuaagcucggcaaggugcaguucgagacgaauacaaccaacgaucuguaugcccaucaaaauacccgguuuacacccgucggggugguucagggaggcgaaagcgcucaccgcucugagccccagcaaugggugcuuccuuccuacagcggcagagacaccccgaacguccaccuggcccccgccguggcuccuacauuccccggggaacagcuccuguuuuuccggucuacgaucccuggauguggcgggcaucccaauauggaucuggacugccuccugccucaggagugggugcagcacuuuuaucaagaggccgcgcccgcucagagcgauguugcccuucugagauucgucaacccggacaccucccgcgugcucuuugaauguaaacugcauaagucuggauacgugacagucgcccacaccggccagcacgaucuugugauuccucccaauggguauuuccgguuugacagcuggguuaaccaguucuacacacuggcuccuaugggcaacggaaccggcagaaaacgcuga

SEQ ID NO: 30138 - RNA, 1617 nt, Artificial Sequence
  derived and/or modified sequence opt5 from VP1__Norovirus_and/or_Norovirus-like__KX354016
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggaggcgucacacauaucccuggcucccacaacuacaccaugaaucucgccagccagaacugguccucuuaugaccccaccgaggaaauuccugcuccccuggggacaccggauuucgugggaaaaauccagggcguccuuacgcagaccacaagcaccaauggguccacaagaggacauaaggcgaccguguacacgggcagcgccgacuuuucuccuaagcuggggcggguucaauucgcuacagacaccaacaaugauuuugagaccaaccagaauacaaaauucacccccgugggagucauucaggacggcuccacaacgccccgcaacgaaccucaacagugggugcucccgagcuacucuggcagaaauauccacaacguucaccuggcccccgccguggcuccuaccuuucccggggagcagcuucuguucuuucggagcacaaugccuggauguuccggcuaucccaauauggaucucgacugccugcugccucaggaauggguccaauacuucuaucaggaggccgcgcccgcucagucugauguggcccuccugcgcuuugugaacccggacaccgggagaguucuuuucgaguguaagcugcauaaaagcggauacgucacaguggcccacaccggccagcaugaucucgugauuccucccaacggguauuuucgguucgacuccugggucaaucaauucuacacgcuggcuccuaugggcaacggaaccggcagacgccgguga

SEQ ID NO: 30139 - RNA, 1617 nt, Artificial Sequence
  derived and/or modified sequence opt5 from VP1__Norovirus_and/or_Norovirus-like__KM245073
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcaucucaucgucgacgugagacaacuggagccugugcugauuccccucccugauguccggaacaauuuuuaucacuacaaccagagcaaugacuccaccaucaagcugauugcuaugcuuuauacaccccugcgcgccaacaacgcuggcgaugacguuuucaccgugagcugcagagugcucacacggcccucuccugauuuugacuucaucuuucuggucccgcccaccguggaaucccgcacgaaaccuuucagcguucccgugcuuaccgucgaggaaaugacaaauucuagauuuccuauuccccuggagaagcuguucaccgggccguccagcgccuucgugguucagccucagaacggacgguguacaaccgauggcgugcugcuggggacgacacaacucucucccgucaauaucugcaccuuucgcggagacgugacacauauuccuggcuccagaaacuacaccaugaaucuggccagccagaacuggaacuccuaugaucccaccgaggaaaucccugcuccccuuggcacaccggacuucgucgggaaaauccagggagugcugacgcagaccacacggaccaauggcucuacacgcgggcacaaggcgaccguuuacacgggaagcgccgacuuuuccccuaagcucggcagagugcaauucgcuacagauaccgacaaugauuuugagaccaaccagaauacaaaauucacccccgucggggugauucaggacggaagcacaacgccccggaacgaaccucaacaguggguucugccgucuuacuccggccgcaauauccauaacgugcaccuugcccccgccgucgcuccuaccuuucccggcgagcagcuccucuucuuuagaagcacaaugccuggguguucuggauaucccaauauggaucuggacugccugcucccucaggaaugggugcaauacuucuaucaggaggccgcgcccgcucagagcgauguggcccugcuucgguuuguuaacccggacaccggcagaguccuguucgaguguaagcuccacaaauccggguacgugacaguggcccauaccggacagcacgaucuggucauuccucccaacggcuauuuucgcuucgacucuugggugaaucaauucuacacgcuugcuccuauggggaacggcaccggacggagacgcuga

SEQ ID NO: 30140 - RNA, 1617 nt, Artificial Sequence
  derived and/or modified sequence opt5 from VP1__Norovirus_and/or_Norovirus-like__LN854567
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgauuucgugguccagccccagaacggacgguguaccacagacggcgugcuccuggggaccacgcaacugagcccugucaauauuugcacauuucgcggagaugugacccauacaaccggcucuagaaacuacaccaugaaucucgccucccagaacuggaauaacuaugaccccacagaggaaacgccugcuccccugggcaccccggacuucguugggaaaauccggggaaugcuuacacagaccacacgcgcggauggcagcaccagagggcacaaggccacgguguacacaggauccgcugacuuugccccuaagcugggccggguccaguucgagaccgauaccgacaaugauuuugacgccaaccaaaauacaaaauucacccccguggggguuauucaggauggaacaacgacccaucgcaacgaacccagacagugggugcucccuucuuacagcggccggaauacacacaacguccaccuggcuccggccguggcgcccaccuuuccuggcgagcaacuucuguucuuuagauccacaaugcccggguguagcggauauccuaauauggaccucgauugccugcugccccaggaaugggugcaguucuuuuaccaggaggcugccccugcccaaucugacguugcucuccugcgcuucgucaaccccgauaccggccgggugcuuuuugaguguaagcugcauaaauccggguaugugacggucgcccacaccggaccgcaugaccucgugaucccucccaacggcuacuucagauucgacagcuggguuaaucaguuuuauacacuggcuccuauggggaacggcaccggacgccggagauga

SEQ ID NO: 30141 - RNA, 1617 nt, Artificial Sequence
  derived and/or modified sequence opt5 from VP1__Norovirus_and/or_Norovirus-like__JN400619
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccugcggcgaauuuacaguguccccucggaaugcccccggggagauucuguggucugcgccucuuggaccggaucugaaccccuaccucagccaccuggcccgcauguauaauggcuacgcugggggauucgaaguccaggugauccuugccggcaacgcuuuuacggccggcaaaauuaucuucgcggccguuccucccaauuuuccuaccgaggggcugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggagaugacguuuucaccgugagcuguagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccggcccguccagcgccuucgugguucagccucagaacgggcggugcacaaccgauggagugcuccugggcacgacacaacugucucccgucaauauuuguaccuuucgcggggacgugacacauaucccuggauccagaaacuacaccaugaaucucgccagccagaacuggaacuccuaugaucccaccgaggaaaucccugcuccccugggcacaccggacuucgucggcaaaauucagggggugcuuacgcagaccacacggaccaauggaucuacacgcggccacaaggcgaccguuuacacggggagcgccgacuuuuccccuaagcugggaagagugcaauucgcuacagauaccgacaaugauuuugagaccaaccagaauacaaaauucacccccgucggcgugauccaggacgggagcacaacgccccggaacgaaccucaacaguggguucucccgucuuacuccggacgcaauauucauaacgugcaccuggcccccgccgucgcuccuaccuuucccggcgagcagcuucuguucuuuagaagcacaaugccuggcugcucuggguaucccaauauggaucucgacugucugcugccucaggaaugggugcaauacuucuaucaggaggccgcgcccgcucagagcgauguggcccuccugcgguuuguuaacccggacaccggaagaguccuuuucgagugcaagcugcacaaauccggcuacgugacaguggcccauaccgggcagcacgaucucgucaucccucccaacggauauuuucgcuucgacucuugggugaaucaauucuacacgcuggcuccuaugggcaacgggaccggccggagacgcuga

SEQ ID NO: 30142 - RNA, 1617 nt, Artificial Sequence
  derived and/or modified sequence opt5 from VP1__Norovirus_and/or_Norovirus-like__KF060052
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaauuccugcuccccugggcacaccggacuucguggggaaaauccagggaguccuuacgcagaccacaucuaccaauggcagcacaagagggcauaaggcgaccguguacacgggauccgccgacuuuagcccuaagcugggccggguucaauucgugacagauaccaauaacgacuuugagaccaaucagaacacaaaauucacccccgucggggugauucaggauggaucuacaacgccccgcaaugaaccucaacaguggguucucccguccuacagcggcagaaacauccacaaugugcaccuggcucccgccgucgccccuaccuuucccggcgagcagcuucuguucuuucggucuacaaugccuggguguagcggauaucccaacauggaccucgauugccugcugccucaggaaugggugcaauacuucuaucaggaggcugcccccgcgcaguccgacguggcucuccugcgcuuuguuaacccggauaccggcagaguccuuuucgaguguaagcugcauaaaucuggguacgugacaguggcccacaccggacagcaugaccucgucauuccucccaauggcuauuuucgguucgauagcugggugaaccaauucuacacgcuggccccuauggggaauggcaccggaagacgccgguga

SEQ ID NO: 30143 - RNA, 1617 nt, Artificial Sequence
  derived and/or modified sequence opt5 from VP1__Norovirus_and/or_Norovirus-like__KF060014
augaagauggccagcuccgacgcuaaccccucugauggcagcaccgccaaucuggugccugaggucuccaacgaaguuauggcgcucgagccgguggugggggcugccaucgccgcucccgucgccggacagcaaaaugugauugacccuuggaucagaaacaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgacagcaccauuaagcucaucgcuaugcuguauacaccccuucgcgccaauucugcuggcgaugacguuuucaccguguccugcagagugcugacacggcccagcccugauuuugacuucauuuuucucgucccgcccaccguggaaucucgcacgaaaccuuucuccguucccauccugaccguggaggaaaugacaaacagcagauuuccuauuccccuugagaagcuguucaccgggccgucuuccgccuucgucgugcagccucagaacggacgguguacaaccgauggcguucuccuggggacgacacaacugagccccgugaauaucugcaccuuucgcggagacgucacacauaucccuggcucccacaacuacaccaugaaucucgccucucagaacuggaauagcuaugaucccaccgaggaaauuccugcuccccugggcacaccggacuucguggggaaaauccagggaguccuuacgcagaccacauccaccaacggcagcacaagagggcauaaggcgaccguguacacgggaucugccgacuuuuccccuaagcugggccggguucaauucgcuacagauaccaauaacgacuuugagaccaaucagaacacaaaauucacccccgugggggucauucaggauggaagcacaacgccccgcaaugaaccucaacagugggugcucccgucuuacagcggcagaaacauccacaauguucaccuggcccccgccguggcuccuaccuuucccggcgagcagcuucuguucuuucgguccacaaugccuggguguucuggauaucccaacauggaccucgauugccugcugccucaggaauggguccaauacuucuaucaggaggccgcgcccgcucagagcgacguggcccuccugcgcuuugugaauccggauaccggcagaguucuuuucgaguguaagcugcauaaauccggguacauuacagucgcccacaccggacagcaugaccucgugaucccucccaacggcuauuuucgguucgauagcugggugaaccaauucuacacgcuggcuccuauggggaauggcaccggaagacgccgguga

SEQ ID NO: 30144 - RNA, 1617 nt, Artificial Sequence
  derived and/or modified sequence opt5 from VP1__Norovirus_and/or_Norovirus-like__KC517375
augaagauggccagcuccgacgcuaaccccucugauggcagcgccgcgaaucuggugccugaggucaacaaugaaguuauggcucucgagccgguggccggggccgcuaucgccgcucccguggccggacagcaaaacgucauugacccuuggaucagaaauaacuucgugcaggcgcccggcggggaauuuaccguuuccccucggaaugcccccggagagauucuguggucugcuccucuuggcccggaucugaaccccuaccucagccaccuggcccgcauguauaauggguacgcuggaggcuucgaagugcaggucauccuugccggcaacgcguuuacagccgggaaagugauuuucgcugccguuccucccaauuuuccuacggagggacugucccccucucaggugaccauguucccgcauaucgucguggacgugagacaacucgagccuguccugaucccccugccugauguucggaacaauuuuuaucacuacaaccagagcaaugaccccacaauuaagcucaucgcuaugcuguaugcuccccuucgcgccaacaacgccggcgaugacguguucaccguguccugcagaguccugacacggccuagcccggauuuugacuucauuuuucucgugcccccuaccguugaaucucgcacaaaacccuucuccgugccuguccugaccguggaggaaaugacgaauagcagauuucccaucccgcuugagaagcuguucaccgggccuucuuccgcguucguugugcagccccagaacggacgguguacaaccgauggcguccuccuggggacaacccaacugagcccugugaauauuugcacguuucgcggagacgucacacauaucaccggcucuagaaacuacacaaugaaucucgccucccagaacuggaauaacuaugaucccaccgaggaaauuccugcuccccugggcaccccggacuucguggggaaaauccagggaguucuuacacagacgacccggacagacggcagcacccgcgggcacaaggccacaguguacaccggauccgccgauuuugcuccuaagcugggcagaguccaauucgagacggacacagaucaugacuuugaagccaaucagaacaccaaauucacccccguggggguuauccaggauggaggcacaacccaccggaaugagccccaacagugggugcucccuucuuacagcggccgcaacacacacaauguccaucuggcgccggcuguggcccccacguuuccuggggaacagcuucuguucuuuagauccaccaugcccggauguagcggcuauccuaacauggaccucgauugccugcugccccaggagugggugcaauacuucuaucaggaggccgcuccugcccagucugacguugcucuccugcgguuugucaaucccgauacagggagagugcuuuucgaauguaagcugcacaaauccggauacgugaccgucgcccauacaggccagcacgaccucgugauuccgccuaacggguauuuucgcuucgauagcuggguuaaccaauucuacacccuggcgcccaugggcaauggaacgggccggagacgcuga

SEQ ID NO: 30145 - RNA, 1617 nt, Artificial Sequence
  derived and/or modified sequence opt5 from VP1__Norovirus_and/or_Norovirus-like__JX644039
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucuccggcagcagaaacuacaccaugaaucucgccucccagaacuggaccucuuaugauccuacagaggaaauucccgcuccucugggcacgcccgacuucguggggaaaauccagggaguccuuacccagacaacccggacaaauggcagcacccgcgggcacaaggcgacgguguacacaggauccgccgacuuuagcccgaagcugggcagaguucaauucgcuaccgauaccgacaacgauuuugagacaaaucagaacaccaaauucacaccugugggggucauucaggacggaucuacgacaccccggaaugaaccccaacagugggugcucccuuccuacagcggccgcaacauccauaauguucaccuggccccggccguggcucccaccuuuccuggcgagcagcuucuguucuuuagaucuaccaugcccggguguagcggauauccuaacauggaucucgacugccugcugccccaggaauggguccaauacuucuaucaggaggccgcgccugcucaguccgauguggcccuccugcgguuugugaaucccgacacaggcagaguucuuuucgaguguaagcugcacaaaucuggguacgucaccguggcccauacgggacagcacgaucucgugauuccgccuaacggcuauuuucgcuucgacagcugggucaaccaauucuacacccuggcucccauggggaauggcacaggacggagacgcuga

SEQ ID NO: 30146 - RNA, 1617 nt, Artificial Sequence
  derived and/or modified sequence opt5 from VP1__Norovirus_and/or_Norovirus-like__JX644031
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacugguccucuuaugaucccaccgaggaaaucccugcuccccugggcacaccggacuucgucgggaaaauucagggagugcuuacgcagaccacacggaccaauggcagcacacgcgggcacaaggcgaccguuuacacgggauccgccgacuuuagcccuaagcugggcagagugcaauucgcuacagauaccgacaacgauuuugagaccaaucagaacacaaaauucacccccgucggggugauccaggacggaucuacaacgccccggaaugaaccucaacaguggguucucccguccuacagcggccgcaacauucauaaugugcaccuggcccccgccgucgcuccuaccuuucccggcgagcagcuucuguucuuuagaucuacaaugccuggguguagcggauaucccaacauggaucucgacugccugcugccucaggaaugggugcaauacuucuaucaggaggccgcgcccgcucaguccgauguggcccuccugcgguuuguuaauccggacaccggcagaguccuuuucgaguguaagcugcacaaaucuggguacgugacaguggcccauaccggacagcacgaucucgucaucccucccaacggcuauuuucgcuucgacagcugggugaaccaauucuacacgcuggcuccuauggggaauggcaccggacggagacgcuga

SEQ ID NO: 30147 - RNA, 1617 nt, Artificial Sequence
  derived and/or modified sequence opt5 from VP1__Norovirus_and/or_Norovirus-like__HM191773
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccugucccgcauguauaauggguacgccggaggcuucgaaguccaggugauccuugcuggcaacgccuuuacggcugggaaaauuaucuucgccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccgggccuuccagcgcuuucgugguucagccccagaacggacgguguacaaccgauggcgugcuccuggggacgacacaacugucuccugucaauauuugcaccuuucgcggagacgugacacauauccccggcuccagaaacuacaccaugaaucucgccagccagaacuggaacuccuaugauccuaccgccgagauccccgcuccgcugggcacaccugacuucgucgggaaaauucagggagugcuuacgcagaccacacggaccaauggcucuacacgcgggcacaaggcgaccguuuacacgggaagcgccgacuuuucccccaagcugggcagagugcaauucgcuacagauaccgacaaugauuuugaaaccaaccagaauacaaaauucacccccgucggggugauccaggacggaagcacaacgccucggaacgagccgcaacaguggguucuccccucuuacuccggccgcaauauucauaacgugcaccuggccccugccgucgcucccaccuuuccuggcgaacagcuucuguucuuuagaagcacaaugcccggguguucuggauauccuaauauggaucucgacugccugcugccccaggagugggugcaauacuucuaucaggaagccgcgccggcucagagcgauguggcccuccugcgguuuguuaacccugacaccggcagaguccuuuucgaguguaagcugcacaaauccggguacgugacaguggcccauaccggacagcacgaucucgucauucccccuaacggcuauuuucgcuucgacucuugggugaaucaauucuacacgcuggcucccauggggaacggcaccggacggagacgcuga

SEQ ID NO: 30148 - RNA, 1617 nt, Artificial Sequence
  derived and/or modified sequence opt5 from VP1__Norovirus_and/or_Norovirus-like__AB504309
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaguccuuacacagaccacacgcggcgacggguccaccagaggacacaaggcgacggugagcacaggcuccguugauuuuaccccuaagcuggggucugugcaauucgccaccgacacagauaacgacuuugagaccggacagaauacacgguucacgcccgucggcgugauucaggauggcagcuccgcucaucgcaacgaaccccaacaguggguucucccugacuacagcgggagaaccgugcacaauguccaccuggccccggccguggcucccacauuuccuggagagcagcuucuguucuuucgguucaccaugcccggcuguucuggguacccuaacauggaucucgacugccugcugccccaggaaugggugcaacauuuuuaucaggaggccgcgccugcucaguccgauguugcccuccugagauucgucaaucccgacacaggacgcgugcuuuuugaguguaaacugcacaagaccggcuacgugacggucgcccauaccgggcagcacgaucucgugaucccgccuaacggcuauuuccgguucgacagcuggguuaaucaauuuuacacacuggcucccaugggaaacggcgccgggagacgccgguga

SEQ ID NO: 30149 - RNA, 1617 nt, Artificial Sequence
  derived and/or modified sequence opt5 from VP1__Norovirus_and/or_Norovirus-like__KX514216
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucucagagacucccccaucuacaccaugaaucuggcuagcccuaacuggaauaacuaugacuccacagaggagauccccgcgccucuuggcacccccgauuucgucggcaaaauucagggggugcugacccagacaacgaagggagaaggcucuacccgggggcaccgcgccacaguuuacgugggaagcgcuaauuacaccccgaagcucggcaaaguccaguuugagacaaacaccacgaaugaccuguaugcccaucaaaacacaaaguucaccccuguggggguugugcagggaggcgaauccgcccacagaagcgagccccagcaauggguccuucccggcuacucugggcgggauaccccuaaugugcaccuggcuccggccguggcgcccacauuuccuggagaacagcuccuguucuuucgcuccaccauccccggcugugggggacauccuaacauggaccuggauugccuccugccccaggaguggguucagcacuucuaucaagaggcugccccugcccagagcgacgucgcucuccugagauuugugaaucccgauacaucucgggugcuuuucgaauguaaacugcauaagagcggcuacgucacgguggcccacaccgggcagcacgaccuuguuauuccgccuaacggcuauuuuagauucgauuccugggugaaccaguuuuacacacuggcucccaugggaaauggcaccgggcgcaaacgguga

SEQ ID NO: 30150 - RNA, 1617 nt, Artificial Sequence
  derived and/or modified sequence opt5 from VP1__Norovirus_and/or_Norovirus-like__KX514212
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaacugaaucccuaccucucucaccuggcucgcauguauaacggguacgccggaggcuucgagguccaggugauccuugcuggcaaugccuuuacagcggggaaaauuaucuucgccgcuguuccucccaacuuuccuacggagggacugagccccucccaggugaccauguucccgcauaucauugucgaugugagacaacucgaaccugugcugaucccccugccugacguccggaauaacuuuuaucacuacaaucagucuaacgauagcacaauuaagcucaucgccaugcuguauacaccccuucgcgcuaacaaugccggcgacgauguuuucaccguguccugcagagugcugacccggcccagcccugacuuugauuucauuuuucucgucccgcccacaguggagucucgcuccaaaccuuucagcguucccgugcugaccguccaggaaaugacgaacucuagauuuccugccacccuugacaagcuguucacagggcccuccagcaaucucgugguucagccgcaaaacggacgguguaugaucgauggcgugcugcuggggaccacacagcucucuccugucaauauuugcaccuuccgcggagacgugacgcaucccagagauuccccuaucuacacaaugaaccuggcuagccccaauuggaacaauuaugacccuaccgaggagauccccgcgccgcuuggcacaccugacuuugucggcaaaauucagggggugcugacccagaccacaaagggagaaggcuccacgcgggggcaccgcgccaccguuuacgugggaucugcuaacuacacacccaagcucggcaaaguccaauucgagaccaauacaaccaacgaucuguaugcccaucagaauacgaaguuuacacccguggggguugugcagggaggcgaaagcgcccacagauccgagccucaacaguggguccuuccgggcuacagcgggcgggacacccccaacgugcaccuggcuccugccguggcgcccaccuucccuggagaacagcuccuguuuuuccgcucuacaauccccggcugugggggacauccuaauauggaucuggacugccuccugccccaggaguggguucaacacuuuuaucaggaggcugccccggcccaguccgaugucgcccuucugagauucgugaacccugacaccagccgggugcucuuugaauguaaacugcauaagucuggcuacgucacaguggcucacacggggcagcacgaucuuguuauucccccuaacggcuauuucagauuugacagcugggugaaucaauucuacacccuggcucccaugggaaacggcacagggcgcaaacgguga

SEQ ID NO: 30151 - RNA, 1617 nt, Artificial Sequence
  derived and/or modified sequence opt5 from VP1__Norovirus_and/or_Norovirus-like__KX354138
augaagauggccagcuccgacgcuaaccccucugauggcagcgccgcgaaucuggugccugaggcuaacaaugaagucauggcccucgagccgguugugggggccgcuaucgccgcucccguggccggacagcaaaacgucauugacccuuggaucagaaauaacuucgugcaggcgcccggcggggaauuuaccauuuccccucggaaugcccccggagagauccuguggucugcuccucuuggcccggaucugaaccccuaccucagccaccuggcccgcauguauaauggguacgcuggaggcuucgaaguucaggugauucuugccggcaacgcguuuacagccgggaaagucaucuucgcugccgugccucccaauuuuccuacggcuggacugucccccucucagguuaccauguucccgagcaucguggucgacgugagacaacucgagccugugcugauuccccugccugauguccggaacaauuuuuaucauuacaaccaguccaaugaccccacaaucacccucauugccaugcuguauacaccccuucgcgccaacaacgcuggcgaugacguuuucaccgugagcugcagagugcugacacggccuucuccggauuuugacuucaucuuucucgugcccccuaccgucgagucccgcacgaagcccuucagcguuccugugcugaccgucgaagagaugacaaauucuagauuucccauuccgcuugaacggcuguucaccgggccuuccagcgcguucgugguucagccccagaacggacgcuguacaaccgauggcgugcuccuggggacgacacaacugucuccugucaauaucugcaccuuuagaggagacauuacacacaucaccggcucccauaacuacaccaugaaucucgccagccagaacuggaauaacuaugaucccacagaggagaucccugcuccccugggcacgccggacuucguggggaaaauucagggaguccuuacccagacaacccggggcgacggguccacacgcggacacaaggccaccguguacacgggcucugccgauuuuagcccuaaacuggggagaguucaauucgaaacagacaccaaucaugauuuugaggcuaaccagaauaccaaguucacacccgugggagucauccaggacggcuccaccacacaccggaacgaaccccaacagugggugcucccuagcuacucuggccgcaauacgcacaacguucaucuggccccggcgguggcucccaccuuuccuggggagcagcuucuguucuuuagauccacaaugcccggauguagcggcuauccuaauauggaucucgacugccugcugccccaggaauggguccaauacuucuaucaggaggccgccccugcucagucugauguggcccuccugcgguuugugaaccccgacaccgggagaguucuuuucgaguguaagcugcacaaaagcggauacauuacagucgcucauaccggccagcacgaucucgugaucccgccuaacggguauuuucgcuucgacuccugggugaaucaauucuacacgcuggcccccaugggcaacggaaccggccggagacgcuga

SEQ ID NO: 30152 - RNA, 1617 nt, Artificial Sequence
  derived and/or modified sequence opt5 from VP1__Norovirus_and/or_Norovirus-like__AB933747
augaagauggccagcuccgacgcuaaccccuucgauggcucuaccgccaaucuggugccugaggucaacaaugaaguuauggcgcucgagccgguggugggggcugccaucgccgcucccgucgccggacagcaaaacgugaucgacccuuggaucagaaauaacuuuguucaggcucccggcggggaguucacagugagcccucggaaugcccccggagaaauucugugguccgcgccucuuggcccggaucugaaccccuaccucucucaccugagccgcauguauaauggguacgccggaggcuuugaaguccaggugauccuugcuggcaacgccuucacggcugggaaaauuaucuuugccgcgguuccucccaauuucccuaccgagggacugucccccucucaggugacaauguuuccgcauaucauugucgacgugagacaacucgagccugugcugaucccccugccugauguccggaacaauuucuaucacuacaaccagagcaaugaccccaccauuaagcucaucgccaugcuguauacaccccuucgcgcuaacaacgccggcgaugacguuuuuaccguguccugcagagugcugacacggccuagcccggauuucgacuuuauuuuccucgugcccccuaccgucgaaucucgcacgaaacccuuuuccguuccugugcugaccgucgaggaaaugacaaauagcagauuccccaucccgcuugagaagcuguucaccgggccuucuuccgcuuuugugguucagccccagaacggacgguguacaaccgauggcgugcuccuggggacgacacaacugagcccugucaauauuugcaccuuccgcggagacgugacacauauccccggcucuagaaacuacaccaugaaucucgccucccagaacuggaauagcuaugauccuaccgaggaaauccccgccccgcugggcacaccugacuuugucgggaaaauucagggagugcuuacgcagaccacacggaccaacggcuccacacgcgggcacaaggcuaccguuuacacgggaucugcggacuucagccccaagcugggcagagugcaauuugccacagauaccgacaaugauuucgagaccaaccagaauacaaaauuuacccccgucggggugauccaggacggauccacaacgccucggaacgaaccgcaacaguggguucuccccagcuacucuggccgcaauauucauaacgugcaccuggcuccugccgucgcccccaccuucccuggcgagcagcuucuguuuuucagauccacaaugcccggguguagcggauauccuaauauggaucucgacugccugcugccccaggaaugggugcaauacuuuuaucaggaggcugccccggcgcagucugauguggcucuccugcgguucguuaacccugacaccggcagaguccuuuuugaguguaagcugcacaaaagcggguacgugacaguggcccauaccggacagcacgaucucgucauucccccuaacggcuauuuccgcuucgacuccugggugaaucaauuuuacacgcuggcccccauggggaacggcaccggacggagacgcuga

SEQ ID NO: 30153 - RNA, 1617 nt, Artificial Sequence
  derived and/or modified sequence opt5 from VP1__Norovirus_and/or_Norovirus-like__KJ955493
augaagauggccagcuccgacgcuaaccccucugauggcagcgccgcgaaucuggugccugaggucaacaaugaaguuauggcucucgagccguucgugggggccgccaucgcugcccccguggcuggacagcaaaacgucauugacccuuggaucagaaauaacuuugugcaggcccccggcggggaguucaccguuuccccucggaaugcgcccggagaaauucuguggucugccccucuuggcccggaucugaaccccuaccucagccaccuggcucgcauguauaauggguacgccggaggcuuugaagugcaggucauccuugcuggcaacgccuucacagcggggaaagugauuuuugccgcuguuccucccaauuucccuacggagggacugucccccucucaggugaccauguuuccgcauaucgucguggacgugagacaacucgagccuguccugaucccccugccugauguucggaacaauuucuaucacuacaaccagagcaaugaccccacaauuaagcucaucgccaugcuguauacaccccuucgcgcuaacaacgccggcgaugacguguuuaccguguccugcagaguccugacccggccuagcccggauuucgacuuuauuuuccucgugcccccuacaguugaaucucgcaccaaacccuuuuccgugccuguccugacgguggaggaaaugaccaauagcagauuccccaucccgcuugagaagcuguucacagggccuucuuccgccuuuguugugcagccccagaacggacgguguaccacagauggcguccuccuggggaccacgcaacugagcccugugaauauuugcacauuccgcggagacgucacccauaucacaggcucuagaaacuacaccaugaaucucgcuucccagaacuggaauaacuaugaucugaccgaggaaauucccgcgccucuuggcacacccgacuuuguggggaaaauccagggaguucugacgcagaccacacggaccgacggcagcacacgcgggcacaaggccaccguguacacgggauccgcugauuucgccccgaagcucggcagaguccaauuugagacagacaccgaucaugacuucgaagccaaucagaacaccaaauuuacaccuguggggguuauccaggauggaggcaccacacaccggucugagccccaacagugggugcugcccagcuacuccggccgcaauacgccuaacguccaccuugcuccggccguggcgcccaccuucccuggggaacagcugcucuuuuucagaagcacaaugcccggauguucuggcuauccuaauauggaccuggauugccugcucccccaggagugggugcaauacuuuuaucaggaggcugccccugcccaguccgacguugcucugcuucgguucgucaaccccgauaccgggagagugcuguuugaauguaagcuccauaaaagcggauacgugacagucgcccacaccggccagcaugaccuggugauuccgccuaauggguauuuccgcuucgauucuuggguuaaccaauuuuacacgcuugcucccaugggcaacggaaccggccggagacgcuga

SEQ ID NO: 30154 - RNA, 1617 nt, Artificial Sequence
  derived and/or modified sequence opt5 from VP1__Norovirus_and/or_Norovirus-like__KJ678153
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuacaccccuugagaagcuguucaccgggccguccagcgccuucgugguccagccucagaacggacgguguacaaccgauggcgugcuccuggggacgacacaacugucucccgucaauaucugcaccuuucgcggagacgugacacauauuaccggcuccagaaacuacaccaugaaucucgcuagccagaacugguccaauuaugauccuacagaggaaauccccgcgccucugggcacgcccgacuucguugggaaaauucagggagugcuuacccagacaacccggacagacggcucuacccgcgggcacaaggccacggucuacaucggaagcgcugauuuugccccgaagcugggcagagugcaauucgagacagacaccgaucaugacuuugaaaccaaccagaauacaaaauucaccccuguuggggugauccaggauggauccacaacgcaccggaacgagccccaacaguggguccuccccagcuacucuggccgcaauaccccuaacgugcaccuggccccggcuguggcccccacauuuccuggcgaacagcuucuguucuuuagauccacccuccccggguguagcggauauccuaauauggaccuggauugccugcucccccaggaguggguucaauacuucuaucaggaggcggcuccugcccagucugacgucgcccugcuucgguuugugaaccccgauacaggcagagugcuguucgaauguaagcuccauaaaagcggguacgucaccguggcucacacgggacagcaugaccugguuauuccgccuaauggcuauuuucgcuucgauuccugggugaaccaauucuacacccuugcccccauggggaacggcacaggacggagacgcuga

SEQ ID NO: 30155 - RNA, 1617 nt, Artificial Sequence
  derived and/or modified sequence opt5 from VP1__Norovirus_and/or_Norovirus-like__KC456071
augaagauggccagcuccgacgcuaaucccccugauggcucugccgcgaaccuggugccgaaagucaacaaugagguuauggcucucgaacccguggugggggccgccaucgcugccccugucgcuggacagcaaaacgugauugaccccuggaucaagaauaacuucguucaggccccuggcggggaguuuaccgugagccccaaaaaugcgccuggagaaauucugugguccgccccgcuuggccccgaucugaacccuuaccucucucaccuggcuagaauguauaauggguacgccggaggcuucgagguccaggugauccuugcuggcaacgccuuuacagcggggaagguuauuuucgccgcugugcccccuaauuuucccacggaaggacugagcccgucccaggucaccauguucccucauaucgugguggacguccggcaacucgagcccguucugaucccucugcccgaugugcgcaacaauuuuuaucacuacaaccagucuaaugaccccacaauuaaacucaucgccaugcuguauaccccucuuagagcuaacaacgccggcgaugacguguucacagucagcugccgggugcugacccgcccgucccccgauuuugacuucauuuuucucguuccucccacaguggagagcagaaccaagccuuucucuguccccgugcugacgguugaagagaugaccaauucccgguuuccgaucccucuugaaaagcuguucacagggcccagcucugccuucgugguccagccucagaacggacgcuguaccacagauggcgugcuccuggggaccacgcaacugucccccgucaauauuugcacauuuagaggagacgugacccauaucacaggcagccggaacuacaccaugaaucucgcuucucagaacuggaauaacuaugauccuaccgaggagauucccgcgccgcugggcacaccugacuucguugggaaaauccagggagugcuuacgcagaccacacgcaccgacggcuccacaagagggcacaaggccaccgucuacacgggaagcgcugauuuugcccccaaacugggccgggugcaauucgaaacagacaccgaucaugacuuugaggccaaucagaacaccaaguucacacccguuggggugauccaggauggauccaccacacaccgcaaugaaccucaacaguggguccucccgucuuacagcggcagagacacgcacaacgugcaucuggcucccgccguggcgccuaccuuucccggcgagcagcuucuguucuuucgguccacaaugccuggguguagcggauaucccaauauggaucucgacugccugcugccucaggaauggguucaauacuucuaucaggaggcugcccccgcccagucugaugucgcucuccugcgcuuugugaacccggacaccggcagagugcuuuucgaguguaaacugcacaaguccggguacgucacaguggcccauaccggacagcacgaucucguuauuccucccaauggcuauuuucgguucgacagcugggugaaccaauucuacacgcuggcuccuauggggaacggcaccggaagacgccgguga

SEQ ID NO: 30156 - RNA, 1617 nt, Artificial Sequence
  derived and/or modified sequence opt5 from VP1__Norovirus_and/or_Norovirus-like__KC175384
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacugggauagcuaugacccuaccgaggaaacacccgcuccgcugggcacgccugacuucgucgggaaaauccagggagugcuuacccagacaacccggacaaauggcuccacccgcgggcacaaggcgacgguuuacacaggaucugccgauuuuagccccaagcugggcagagugcaauucgcuaccgacaccgauaacgacuuugagacaaaucagaacaccaaauucacacccgucggggugauucaggauggauccacgaccccucggaaugaaccgcaacaguggguucuccccagcuacucuggccgcaacauccauaaugugcaccuggccccugccgucgcucccacauuuccuggcgagcagcuucuguucuuuagauccaccaugcccggguguagcggauauccuaacauggaccucgauugccugcugccccaggaaugggugcaauacuucuaucaggaggccgcgccggcucagucugacguggcccuccugcgguuuguuaauccugauacaggcagaguccuuuucgaguguaagcugcacaaaagcggguacgugaccguggcccauacgggacagcacgaccucgucauucccccuaacggcuauuuucgcuucgauuccugggugaaccaauucuacacccuggcucccauggggaauggcacaggacggagacgcuga

SEQ ID NO: 30157 - RNA, 1617 nt, Artificial Sequence
  derived and/or modified sequence opt5 from VP1__Norovirus_and/or_Norovirus-like__JQ613561
augaagauggccagcuccgacgcuaaccccucugauggcagcaccgccaaucuggugccugaggucaacacagaaguuauggcgcucgagccgguggugggggcugccaucgccgcucccgucgccggacagcaaaaugugaucgacccuuggaucagaaacaauuucguucaggcucccggcggggaauuuacgguguccccucggaacgcccccggagagauucuguggucugcgccucuuggcccggaucugaaucccuaccucagccaccuggcccgcauguauaacggguacgcuggaggcuucgaaguccaggugauccuugccggcaaugcuuuuaccgccgggaaaauuaucuucgcggccguuccucccaacuuuccuacagagggacugucccccucucaggugaccauguucccgcauaucauugucgacgugagacaacucgagccugugcugaucccccugccugauguccggaauaacuuuuaucacuacaaucagagcaacgaccccacaauuaagcucaucgcuaugcuguauacaccccuucgcgccaauaacgcuggcgaugacguuuucaccguguccugcagagugcugacccggccuagcccggauuuugacuucauuuuucucgugcccccuacggucgaaucucgcaccaaacccuucuccguuccugugcugacagucgaggaaaugaccaacagcagauuucccaucccgcuugagaagcuguucacagggccuucuuccgccuucgugguucagccccagaauggacgguguaccacggauggcgugcuccuggggacaacccaacugagcccugucaacauuugcacauuucgcggagacgugacccauauccccggcucuagaaauuacaccaugaaccucgccucccagaauuggaacagcuaugauccuacagaggaaauccccgcuccgcugggcacgccugacuucgucgggaaaauucagggagugcuuacccagacaacccggacaaauggcuccacccgcgggcacaaggcgacgguuuacacaggaucugccgacuuuagccccaagcugggcagagugcaauucgcuaccgauaccgacaacgauuuugagacaaaucagaacaccaaauucacacccgucggggugauccaggacggauccacgaccccucggaaugaaccgcaacaguggguucuccccagcuacucuggccgcaacauucauaaugugcaccuggccccugccgucgcucccacauuuccuggcgagcagcuucuguucuuuagauccaccaugcccggguguagcggauauccuaacauggaucucgacugccugcugccccaggaaugggugcaauacuucuaucaggaggccgcgccggcucagucugaugccgcccuccugcgguuugugaauccugacacaggcagaguucuuuucgaguguaagcugcacaaaagcggguacgucaccguggcucauacgggacagcacgaucucgugauucccccuaacggcuauuuucgcuucgacuccugggucaaccaauucuacacccuggcccccauggggaauggcacaggacggagacgcuga

SEQ ID NO: 30158 - RNA, 1617 nt, Artificial Sequence
  derived and/or modified sequence opt5 from VP1__Norovirus_and/or_Norovirus-like__KJ678145
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuacaccccuugagaagcuguucaccgggccguccagcgccuucgugguccagccucagaacggacgguguacaaccgauggcgugcuccuggggacgacacaacugucucccgucaauaucugcaccuuucgcggagacgugacacauauuaccggcuccagaaacuacaccaugaaucucgcuagccagaacugguccaauuaugauccuacagaggaaauccccgcgccucugggcacgcccgacuucguugggaaaauucagggagugcuuacccagacaacccggacagacggcucuacccgcgggcacaaggccacggucuacacaggaagcgcugauuuugccccgaagcugggcagagugcaauucgagaccgacaccgaucaugacuuugaaacaaaccagaauaccaaauucacaccuguuggggugauccaggauggauccacgacccaccggaacgagccccaacaguggguccuccccagcuacucuggccgcaauacaccuaacgugcaccuggccccggcuguggcccccaccuuuccuggcgaacagcuucuguucuuuagauccacaaugcccggguguagcggauauccuaauauggaccucgauugccugcugccccaggaguggguucaauacuucuaucaggaggcggcuccugcccagucugacgucgcccuccugcgguuugugaaccccgauaccggcagagugcuuuucgaauguaagcugcauaaaagcggguacgucacgguggcucacaccggacagcaugaccucguuaucccgccuaauggcuauuuucgcuucgaguccugggugaaccaauucuacacacuggcccccauggggaacggcaccggacggagacgcuga

SEQ ID NO: 30159 - RNA, 1617 nt, Artificial Sequence
  derived and/or modified sequence opt5 from VP1__Norovirus_and/or_Norovirus-like__KF060116
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaaccccugcuccccugggcacgccggacuucguggggaaaauucagggaguccuuacccagacaaccucuacaaauggcagcaccagagggcauaaggcgacgguguacacaggauccgccgacuuuagcccuaagcugggccggguucaauucgcuaccgauaccaauaacgacuuugagacaaaucagaacaccaaauucacacccgugggggucauccaggauggaucuacgacaccccgcaaugaaccucaacagugggugcucccguccuacagcggcagaaacauucacaauguucaccuggcccccgccguggcuccuacauuucccggcgagcagcuucuguucuuucggucuaccaugccuggguguagcggauaucccaacauggaccucgauugccugcugccucaggaauggguccaauacuucuaucaggaggccgcgcccgcucaguccgacguggcccuccugcgcuuugugaacccggauacaggcagaguucuuuucgaguguaagcugcauaaaucuggguacgucaccguggcccacacgggacagcaugaccucgugaucccucccaauggcuauuuucgguucgauagcugggucaaccaauucuacacccuggcuccuauggggaauggcacaggaagacgccgguga

SEQ ID NO: 30160 - RNA, 1617 nt, Artificial Sequence
  derived and/or modified sequence opt5 from VP1__Norovirus_and/or_Norovirus-like__KC517362
augaagauggccagcuccgacgcuaaccccucugauggcagcgccgcgaaucuggugccugaggucaacaaugaaguuaucgcucucgagccgguggugggggccgccauugcugcccccgucgcuggacagcaaaacgugaucgacccuuggauuagaaauaacuucguucaggcccccggcggggaauuuaccguguccccucggaaugcgcccggagagauccuguggucugccccucuuggcccggaucugaaccccuaccucagccaccuggcucgcauguauaauggguacgccggaggcuucgaaguccaggugauucuugcuggcaacgccuuuacagcggggaaaguuaucuucgccgcugugccucccaauuuuccuacggagggacugucccccucucaggucaccauguucccgcauaucgugguggacgucagacaacucgagccuguucugauuccccugccugaugugcggaacaauuuuuaucacuacaaccagagcaaugaccccacaaucaagcucauugccaugcuguauacaccccuucgcgcuaacaacgccggcgaugacguguucaccgucuccugcagagugcugacccggccuagcccggauuuugacuucaucuuucucguucccccuacaguggaaucucgcaccaaacccuucuccgucccugugcugacgguugaggaaaugaccaauagcagauuucccauuccgcuugagaagcuguucacagggccuucuuccgccuucgugguccagccccagaacggacgguguaccacagauggcgugcuccuggggaccacgcaacugagcccugucaauaucugcacauuucgcggagacauugcucauaucaccggcucuagaaacuacacaaugaaucucgcgucccagaacuggaauaacuaugaucccaccgaggaaaucccugcuccccugggcaccccggacuucguggggaaaauucagggaguucuuacacagacgacccggacagacggcagcacccgcgggcacaaggccacaguguacaccggauccgccgauuuugccccuaagcugggcagaguccaauucgagacggacacagaucaugacuuugaagcuaaucagaacaccaaauucacccccguggggguuauccaggauggaggcacaacccaccggaaugagccccaacagugggugcucccuucuuacagcggccgcaacacacacaauguccaucuggccccggcgguggcucccacguuuccuggggaacagcuucuguucuuuagauccaccaugcccggauguagcggcuauccuaacauggaccucgauugccugcugccccaggagugggugcaauacuucuaucaggaggccgccccugcucagucugacguugcccuccugcgguuugucaaucccgauacagggagagugcuuuucgaauguaaccugcacaaguccggauacgugaccgucgcucauacaggccagcacgaccucgugauuccgccuaacggguauuuucgcuucgauagcuggguuaaucaauucuacacccuggcccccaugggcaacggaacgggccggagacgcuga

SEQ ID NO: 30161 - RNA, 1617 nt, Artificial Sequence
  derived and/or modified sequence opt5 from VP1__Norovirus_and/or_Norovirus-like__JX644038
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaaugucugcaccuuucgcggagacgugacacauaucuccggcagcagaaacuacaccaugaaucucgccucccagaacuggaccucuuaugauccuacagaggaaauccccgcuccucugggcacgcccgacuucgucgggaaaauucagggagugcuuacccagacaacccggacaaauggcagcacccgcgggcacaaggcgacgguuuacacaggauccgccgacuuuagcccgaagcugggcagagugcaauucgcuaccgauaccgacaacgauuuugagacaaaucagaacaccaaauucacaccugucggggugauccaggacggaucuacgacaccccggaaugaaccccaacaguggguucucccuuccuacagcggccgcaacauucauaaugugcaccuggccccggccgucgcucccaccuuuccuggcgagcagcuucuguucuuuagaucuaccaugcccggguguagcggauauccuaacauggaucucgacugccugcugccccaggaaugggugcaauacuucuaucaggaggccgcgccugcucaguccgauguggcccuccugcgguuuguuaaucccgacacaggcagaguccuuuucgaguguaagcugcacaaaucuggguacgugaccguggcccauacgggacagcacgaucucgucaucccgccuaacggcuauuuucgcuucgacagcugggugaaccaauucuacacccuggcucccauggggaauggcacaggacggagacgcuga

SEQ ID NO: 30162 - RNA, 1617 nt, Artificial Sequence
  derived and/or modified sequence opt5 from VP1__Norovirus_and/or_Norovirus-like__AB504313
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacacgcggcgacgggcugaccagaggacacaaggcgacggucuccacaggcagcguggauuuuaccccuaagcucggguccguucaauucgccaccgacacagauaacgacuuugagaccggacagaauacacgguucacgcccgugggcgucauucaggauggcucuagcgcucaucgcaacgaaccccaacagugggugcugccugacuacuccgggagaaccguucacaaugugcaccuugccccggccgucgcucccacauuuccuggagagcagcuccuguucuuucggagcaccaugcccggcuguucuggguacccuaacauggaucuggacugccugcucccccaggaaugggugcaacauuucuaucaggaggccgcgccugcucaguccgauguggcccugcuuagauuuguugaccccgauacaggacgcguccuguucgaguguaaacuccacaagaccggcuacgugacgguggcccauaccgggcagcacgaccuggucaucccgccuaauggcuauuuucgguucgacagcugggugaaccaauucuacacacuugcucccaugggaaauggcgccgggagacgccgguga

SEQ ID NO: 30163 - RNA, 1617 nt, Artificial Sequence
  derived and/or modified sequence opt5 from VP1__Norovirus_and/or_Norovirus-like__KX514361
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccaaaaucuacaccaugaaucucgcuagcccuaacuggaauaacuaugaccccacagaggagaucccugcgccccugggcaccccggauuucgucggcaagauucaggggaugcuuacccagacaacgaagggagaaggcuccacccgggggcaccgcgccacaguguacguuggaucugcuaauuacgccccuaaacugggcagagugcaguuugagaccgacacaaccgaugaccucgaugcccaucaaaacacgaaguucacacccgucggggugguucagggaggcgaaagccccaaaggcuccgagccucagcaaugggugcugccgagcuauucugggaaggacacccccaauguccaccuugcuccugccguggcgcccaccuuuccuggagaacagcuccuguucuuucgguccacaauccccggcugugggggacacccuaacaugaaucuggauugccugcucccccaggagugggugcagcauuucuaccaagaggcugccccggcccagagcgacguugcucugcuucgcuuugucaacccugauaccucuagagugcuguucgaauguaaacuccacaagagcggcuaugugacagucgcccauacggggcagcacgaccuggugauucccccuaauggcuacuuucgguucgauuccuggguuaaccaguuuuauacccuugcucccaugggaaacggcacagggagaaagcgcuga

SEQ ID NO: 30164 - RNA, 1617 nt, Artificial Sequence
  derived and/or modified sequence opt5 from VP1__Norovirus_and/or_Norovirus-like__KX514336
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacauuccggcaauagcaaaaucuacaccaugaaccucgcuucccccaauuggaacaauuaugacccuacagaggagauccccgcgccucugggcacccccgacuucgucgggaagauucagggaaugcuuacccagacaacgaagggcgaagggucuaccagaggacaccgggccacaguguacguuggcagcgcuaacuacgccccgaaacuggggcgcgugcaguuugagaccgauacaaccgacgaucucgacgcccaucaaaauacgaaguucacaccugucggagugguucagggcggcgaaucccccaaagggagcgagccccagcaaugggugcugccuucuuauuccggaagagauaccccgaacguccaccuugcucccgccguggcgccuaccuuucccggcgaacagcuccuguucuuucggagcacaaucccuggguguggaggccaccccaauaugaaccuggacugccugcucccucaggagugggugcagcauuucuaccaagaggcugcccccgcccagucugauguugcucugcuucgcuuugucaauccggacaccagcagagugcuguucgaauguaagcuccacaaauccggguaugugacagucgcccauacgggccagcacgaucuggugauuccucccaacggauacuuucgguucgacucuuggguuaaccaguuuuauacccuugcuccuaugggcaaugggacaggaagaaagcgcuga

SEQ ID NO: 30165 - RNA, 1617 nt, Artificial Sequence
  derived and/or modified sequence opt5 from VP1__Norovirus_and/or_Norovirus-like__KX514203
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcagcaaacccuucucuguuccugugcugacgguccaggagaugaccaacuccagauuucccgccacacuugauaagcuguucaccgggccgagcucuacacucgugguucagccucaaaauggacgguguaugaucgacggcgugcugcuggggaccacgcagcucucccccgucaacauuugcacauuccgcggagaugugacccauagcagagacuccacaaucuacaccaugaaucuggccucuccuaacuggaauaacuaugaccccaccgaagagaucccugcuccccuuggcacaccggauuuugucggcaaaauucagggggugcugacgcagaccacaaagggagagggcagcacccgggggcaccgcgcgacaguuuacgugggauccgccaauuacaccccuaagcucggcaaaguccaauucgaaacgaacacaaccaaugaccuguaugcucaucagaacaccagauuuacacccguggggguugugcagggaggcgagagcgcccaccggucugaaccccaacaguggguccuuccuuccuacagcggccgcgauaccccgaaugugcaccuggcccccgcuguggccccuacauuccccggggagcagcuccuguuuuucagaucuacgaucccuggauguggcgggcaucccaacauggaccuggauugccuccugccucaggaauggguucaacacuuuuaucaggaggcggcucccgcccagagcgacgucgcccuucugcgguucgugaauccggauaccuccagagugcucuuugaguguaagcugcauaaaucuggauacgucacaguggcucacaccggccagcacgaccuuguuauuccucccaacggguauuuccgcuuugauagcugggugaaucaauucuacacacuggccccuaugggcaacggaaccggccggaagagauga

SEQ ID NO: 30166 - RNA, 1617 nt, Artificial Sequence
  derived and/or modified sequence opt5 from VP1__Norovirus_and/or_Norovirus-like__KP784693
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgagggcgugcuccuggggacgacacaacugucucccgucaauauuugcaccuuucgcggagaugugacacauaucuccggcagcagaaacuacaccaugaaucucgccucccagaacuggaacucuuaugacccuaccgaagagauccccgcuccucugggcacacccgauuucgucgggaaaauucagggagugcuuacgcagaccacacggaccgacggcagcacacgcgggcacaaggcgaccguuuacacgggauccgccgacuuuagcccgaagcugggcagagugcaauucgcuacagauaccgacaaugauuuugucaccaaucagaacacaaaauucaccccuguggggguuauccaggacggaucuacaacgccccggaaugaaccccaacagugggugcucccuuccuacagcggccgcaacacccauaauguccaccuggccccggccguggcucccacauuuccuggcgagcagcuucuguucuuuagaucuaccaugcccggguguagcggauauccuaacauggaucucgacugccugcugccccaggaaugggugcaauacuucuaucaggaggccgcgccugcucaguccgauguugcccuccugcgguuugucaaucccgacacaggcagagugcuuuucgaguguaagcugcacaaaucuggguacgugaccgucgcccauacgggacagcacgaucucgugauuccgccuaacggcuauuuucgcuucgacagcuggguuaaccaauucuacacccuggcucccauggggaauggcgccggacggagacgcuga

SEQ ID NO: 30167 - RNA, 1617 nt, Artificial Sequence
  derived and/or modified sequence opt5 from VP1__Norovirus_and/or_Norovirus-like__AB933734
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaauccgagacgaaaccuuucuuuuuccccguucugaccguggaagagaugacaaauagccgcuucccuaucccccuugagaagcuguuuaccgggccgucuuccgccuucgucgugcagccucagaacggaagauguacaaccgauggcguucuccuggggacgacacaacugagccccgugaauauuugcaccuuucggggagacgucacacauaucccuggcucucgcaacuacaccaugaaucucgccucccagaacuggaauagcuaugaucccaccgaagagaucccugcuccccugggcacaccggacuucguggggaaaauucagggaguccuuacgcagaccacaagaaccaacggcuccacacgggggcacaaggcgaccguguacacgggaucugccgacuuuagcccuaagcugggccgcguucaauucgcuacagauaccgacaaugauuuugaaaccaaccagaauacaaaauucacccccgugggggucauccaggacggauccacaacgcccagaaacgagccucaacagugggugcucccgagcuacucuggccggaauauucauaacguucaccuggcccccgccguggcuccuaccuuucccggcgaacagcuucuguucuuucgcuccacaaugccuggguguagcggauaucccaauauggaucucgacugccugcugccucaggaguggguccaauacuucuaucaggaggccgcgcccgcucagucugauguggcccuccugagauuugugaacccggacaccggccggguucuuuucgaauguaagcugcacaaaagcggguacgucacaguggcccauaccggacagcacgaucucgugaucccucccaacggcuauuucagauuugacuccugggucaaucaauucuacacgcuggcuccuauggggaacggcaccggacgccggagauga

SEQ ID NO: 30168 - RNA, 1617 nt, Artificial Sequence
  derived and/or modified sequence opt5 from VP1__Norovirus_and/or_Norovirus-like__KF060041
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucggcguccaggugauccuugcugggaacgccuuuacagcgggaaaaguuauuuucgccgcugugccucccaauuuuccuacggaaggccugucccccucucaggucaccauguucccgcauaucguggugaacgucagacaacucgagccuguucugaucccccugccugacgugcggaauaacuuuuaucacuacaaucagagcaacgaucccacaauuaagcucaucgccaugcuguauacaccccuucgcgcuaacaaugccggggacgauguguucacagucuccugcagagugcugacccggccuagcccggacuuugauuucauuuuucucguucccccuacaguggagucucgcaccaaacccuucuccgucccugugcugacgguugaagagaugaccaacagcagauuucccaucccgcuugaaaagcuguucacaggaccuucuuccgccuucgugguccagccccagaauggccgguguaccacagacggggugcuccugggaaccacgcaacugagcccugucaacauuugcacauuucgcggcgaugugacccauaucacaggcucuagaaauuacaccaugaaccucgcuucccagaauuggaacaauuaugaccccaccgaggagaccccugcgccccuggggacgccggauuucguuggaaaaauucagggcgugcuuacccagacaacccggacagacgggagcacccgcggacacaaggccacggucuacacaggcuccgcugacuuugccccuaagcuggggagagugcaauucgaaaccgauaccgaccaugauuuugaggccaaccagaauacaaaauucacccccguuggagugauccaggacggcucuacaacgcaccggaacgaaccccaacaguggguccucccuagcuacuccggccgcaauacccacaacgugcaucuggcuccggccguggcgcccacauuuccuggggagcagcuucuguucuuuagaagcaccaugcccggauguucuggcuauccuaauauggaucucgacugccugcugccccaggaauggguucaauacuucuaucaggaggcugccccugcccaguccgaugucgcucuccugcgguuugugaaccccgacacagggagagugcuuuucgaguguaagcugcacaaaagcggauacgucaccguggcccucacgggccagcaugaucugguuaucccgccuaacggguauuuucgcuucgacucuugggugaaucaauucuacacccuugcucccaugggcaacggaacaggccggagacgcuga

SEQ ID NO: 30169 - RNA, 1617 nt, Artificial Sequence
  derived and/or modified sequence opt5 from VP1__Norovirus_and/or_Norovirus-like__JX989074
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaccccugcuccccugggcacgccggacuucgucgggaaaauccagggagugcuuacccagacaacccggacaaauggcucuacccgcgggcacaaggcgacgguuuacacaggaagcgccgacuuuuccccuaagcugggcagagugcaauucgcuaccgauaccgacaaugauuuugagacaaaccagaauaccaaauucacacccgucggggugauucaggacggaagcacgacaccccggaacgaaccucaacaguggguucucccgucuuacuccggccgcaauauccauaacgugcaccuggcccccgccgucgcuccuacauuucccggcgagcagcuucuguucuuuagaagcaccaugccuggguguucuggauaucccaauauggaucucgacugccugcugccucaggaaugggugcaauacuucuaucaggaggccgcgcccgcucagagcgauguggcccuccugcgguuuguuaacccggacacaggcagaguccuuuucgaguguaagcugcacaaauccggguacgugaccguggcccauacgggacagcacgaucucgucauuccucccaacggcuauuuucgcuucgacucuugggugaaucaauucuacacccuggcuccuauggggaacggcacaggacggagacgcuga

SEQ ID NO: 30170 - RNA, 1617 nt, Artificial Sequence
  derived and/or modified sequence opt5 from VP1__Norovirus_and/or_Norovirus-like__JN400624
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacgaucgguguacaaccgacggagugcuccugggcacgacacaacugagcccugucaauauuugcaccuuucgcggggaugugacacauauccccggaucuagaaacuacaccaugaaucucgccucccagaacuggaauagcuaugacccuaccgaggaaauccccgcuccgcugggcacaccugacuucgucggcaaaauucagggggugcuuacgcagaccacacggaccaacggauccacacgcggccacaaggcgaccguuuacacggggucugccgauuuuagccccaagcugggaagagugcaauucgcuacagacaccgauaaugacuuugagaccaaccagaauacaaaauucacccccgucggcgugauccaggauggguccacaacgccucggaacgaaccgcaacaguggguucuccccagcuacucuggacgcaauauucauuccgugcaccuggccccugccgucgcucccaccuuuccuggcgagcagcuucuguucuuuagaagcacaaugcccggcuguucuggguauccuaacauggaccucgauugccugcugccccaggaaugggugcaauacuucuaucaggaggccgcgccggcucagagcgacguggcccuccugcgguuuguuaauccugauaccggaagaguccuuuucgaguguaagcugcacaaauccggcuacgugacaguggcccauaccgggcagcacgaccucgucauucccccuaacggauauuuucgcuucgauucuugggugaaccaauucuacacgcuggcucccaugggcaaugggaccggccggagacgcuga

SEQ ID NO: 30171 - RNA, 1617 nt, Artificial Sequence
  derived and/or modified sequence opt5 from VP1__Norovirus_and/or_Norovirus-like__EU876894
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuagaauccggaauaacuucguucaggcucccggcggggaauuuacaguguccccucgcaaugcccccggagagauucuguggucugcgccucuuggcccggaucugaaccccuaccucagccaccuggccagaauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugcggcaacucgagccugugcugaucccccugccugauguccgcaacaauuuuuaucacuacaaccaguccaaugaccccaccauuaagcucaucgcuaugcuguauacaccccuuagagccaacaacgcuggagaugacguuuucaccgugagcugcugggugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcaaaauccaggggguccuuacccaaacaaccagaagcgacggauccacacggggccacaaggccaccgugucuacggggagcguucauuuuacaccuaagcugggacgcauucaguucuccaccgauaccagcaacgacuuugaaacaggccagaauaccagauucacacccgugggggucgugcaagauggaucuacgacccaccagaacgagccccagcaguggguucucccuaauuacuccggccgggacagccacaacgugcaucuggcuccggccgucgcccccucuuuuccuggcgaacaacuucuguucuuucgcagcacaaugcccggguguuccggauacccuaauaugaaccucgauugccugcugccccaggagugggugcagcacuucuaucaggaggcugccccugcgcaaucugacguggcucuccugagauuuguuaaucccgauaccggccggguccuuuucgaauguaaacugcauaagagcggguacgugacaguggcccacaccggacagcacgaccucgucaucccgccuaacggcuauuuuagauucgauuccugggugaaccaguucuacacgcuggcccccauggggaauggcaccggacgccggagauga

SEQ ID NO: 30172 - RNA, 1617 nt, Artificial Sequence
  derived and/or modified sequence opt5 from VP1__Norovirus_and/or_Norovirus-like__KX514173
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccgucaaucuugaacggcuguucacaggaccguccagcgcuaacgugguucagccucagaauggccgcuguaccauugauggggagcuccugggaacgacacaacugucuuccgugaacaucugcaccuucagaggcgacgucacacauaucggcaccacccggcacuggacaaugaaucucgccagccccaacuggaauaacuacgauccuacggaggaaacccccgccccucuggggacacccgacuuugugggaaagauucagggcaugcuuacccagacaaccaaaggggagggauccacgcgcggccauagagcuacagucuauguggggucugcgaauuacgccccgaagcugggacggguucaguucgaaaccgacaccacaaacgaucucgacgcucaccaaaauaccaaguuuacaccugugggcgucgugcagggcggggagagccccaaaggauccgaaccccagcaauggguucugccuagcuacucuggccgcgauacgccgaacgugcaccuugcccccgccgucgcuccuaccuuccccggggagcagcugcucuuuuucagauccacaaucccuggauguggcgggcaucccaauaugaaccuggacugccugcucccucaggagugggugcagcacuuuuaucaagaagccgcgcccgcucagagcgauguggcccugcuucgguucguuaauccggacaccucuagaguccuguuugaguguaagcuccauaaaagcggcuacgugacaguggcccacaccggacaguaugaucugguccuuccuuccaacggcuacuuccgcuuugacucuugggugaaccaguucuauacgcuggcucccauggggaauggaaccggccggagacgcuga

SEQ ID NO: 30173 - RNA, 1617 nt, Artificial Sequence
  derived and/or modified sequence opt5 from VP1__Norovirus_and/or_Norovirus-like__KX353989
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauggucccgcauaucauuguggacgugagacaacucgagccuguccugaucccccugccugauguucggaacaauuucuaucacuacaaccagagcaaugacuccaccauuaagcucaucgcuaugcuguauacaccccuucgcgccaacaacgcuggcgaugacguguuuaccgugagcugcagaguccugacacggcccucuccugauuucgacuuuauuuuccucgugccgcccaccguugaaucccgcacgaaaccuuuuagcgugcccauccugaccgucgaggaaaugacaaauucuagauucccuauuccccuugagaagcuguuuaccgggccguccagcgccuucgugguucagccucagaacggacgguguacaaccgauggcgugcuccuggggacgacacaacugucucccgucaauaucugcaccuuccgcggagacgugacacauaucccuggcucccacaacuacaccaugaaucucgccagccagaacuggaacuccuaugaucccaccgaggaaauuccugcuccccugggcacaccggacuuugucgggaaaauccagggagugcuuacgcagaccacaucuaccaauggcagcacaagagggcauaaggcgaccguuuacacgggauccgccgacuucagcccuaagcugggccgggugcaauuugcuacagauaccaauaacgacuucgagaccaaucagaacacaaaauuuacccccgucggggugauucaggauggaucuacaacgccccgcaaugaaccucaacaguggguucucccguccuacagcggcagaaacauccacaaugugcaccuggcccccgccgucgcuccuaccuuccccggcgagcagcuucuguuuuuccggucuacaaugccuggguguagcggauaucccaacauggaccucgauugccugcugccucaggaaugggugcaauacuuuuaucaggaggccgcgcccgcucaguccgacguggcccuccugcgcuucguuaacccggauaccggcagaguccuuuuugaguguaagcugcauaaaucuggguacgugacaguggcccacaccggacagcaugaccucgucauuccucccaauggcuauuuccgguuugauagcugggugaaccaauucuacacgcuggcuccuauggggaauggcaccggaagacgccgguga

SEQ ID NO: 30174 - RNA, 1617 nt, Artificial Sequence
  derived and/or modified sequence opt5 from VP1__Norovirus_and/or_Norovirus-like__KX353962
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauccuagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccaggacacaaaauucacccccgucggggugauccaggauggauccacaacgccucggaaugaaccgcaacaguggguucuccccagcuacucuggccgcaacauucauaaugugcaccuggccccugccgucgcucccaccuuuccuggcgagcagcuucuguucuuuagauccacaaugcccggguguagcggauauccuaacauggaccucgauugccugcugccccaggaaugggugcaauacuucuaucaggaggccgcgccggcucagucugacguggcccuccugcgguuuguuaauccugauaccggcagaguccuuuucgaguguaagcugcacaaaagcggguacgugacaguggcccauaccggacagcacgaccucgucauucccccuaacggcuauuuucgcuucgauuccugggugaaccaauucuacacgcuggcucccauggggaauggcaccggacggagacgcuga

SEQ ID NO: 30175 - RNA, 1617 nt, Artificial Sequence
  derived and/or modified sequence opt5 from VP1__Norovirus_and/or_Norovirus-like__AB972515
augaagauggccagcuccgacgcuaaccccucugauggcagcaccgccaaucuggugccugaggucaacaaugaaguuauggcgcucgagccggugaucggggcugccauugccgcucccguggccggacagcaaaacgucaucgacccuuggauuagaaauaacuucgugcaggcucccggcggggaauuuacaguuuccccucggaaugcccccggagagauccuguggucugcgccucuuggcccggaucugaaccccuaccucagccaccugucccgcauguauaauggguacgccggaggcuucgaagugcaggucauucuugcuggcaacgccuuuacggcugggaaaaucaucuucgccgcggugccucccaauuuuccuaccgagggacugucucccagccagguuacaauguucccgcauaugauuguggacgucagacaacucgagccugugcugaucccccugccugaugugcggaacaauuuuuaucacuacaaccaguccaaugacagcaccauuaagcucaucgccaugcuguauacaccccuucgcgcuaacaacgccggcgaugacgucuucaccguuucuugcagagugcugacacggcccuccccugauuuugacuucauuuuucucgugccgcccaccgucgaaagccgcacgaaaccuuucucugugcccguucugaccguggaggaaaugacaaauuccagauuuccuaucccccuugagaagcuguucaccgggccgagcucugcuuucgucgugcagccucagaacggacgguguacaaccgauggcguucuccuggggacgacacaacugucccccgugaauauuugcaccuuucgcggagacgucacacauaucccuggcagcagaaacuacaccaugaaucucgccucccagaacuggaacucuuaugaucccaccgaggaaaucccugcuccccugggcacaccggacuucguggggaaaauucagggaguccuuacgcagaccacacggaccaauggcagcacacgcgggcacaaggccaccguguacacgggauccgcggacuuuagcccuaagcugggcagaguucaauucgccacagauaccgacaaugauuuugagaccaaccagaauacaaaauucacccccgugggggucauccaggacggaucuacaacgccccggaacgaaccucaacagugggugcucccguccuacagcggccgcaauauucauaacguucaccuggcucccgccguggccccuaccuuucccggcgagcagcuucuguucuuuagaucuacaaugccuggguguagcggauaucccaauauggaucucgacugccugcugccucaggaauggguccaauacuucuaucaggaggcugcccccgcgcaguccgauguggcucuccugcgguuugugaacccggacaccggcagaguucuuuucgaguguaagcugcacaaaucuggguacgucacaguggcccauaccggacagcacgaucucgugaucccucccaacggcuauuuucgcuucgacagcugggucaaucaauucuacacgcuggccccuauggggaacggcaccggacggagacgcuga

SEQ ID NO: 30176 - RNA, 1617 nt, Artificial Sequence
  derived and/or modified sequence opt5 from VP1__Norovirus_and/or_Norovirus-like__KT033904
augaagauggccagcaacgacgcuaaucccuccgauggcucugccgcgaaccuggugccuaaagucaauaacgagguuauggcucucgaaccgguggugggggccgccaucgcugcccccgucgcuggacagcaaaaugugauugacccuuggaucaagaacaauuucguucaggcccccggcgggaaauuuaccgugagcccuaagaacgcgcccggagagauucugugguccgccccucuuggcccggaucugaaucccuaccucucucaccuggcuagaauguauaaagggcaugccggaggcuucgaaguccaggugauccuugcuggcaacgccuuuacagcggggaagauuaucuucgccgcuguuccucccaauuuuccuacggagggacugagccccucccaggugaccauguucccgcacaucauugucgacgugcggcaacucgaaccugugcugaucccccugccugauguccgcaacaauuuuuaccauuauaaccagucuaaugacagcacaauuaagcucaucgccaugcuguacacaccccuuagagcuaacaacgccggcgaggauguuuucaccguguccugccgggugcugacccgccccagcccugacuuugauuucauuuuucucgucccgcccacaguggagucuagaaccaaaccuuucacgguucccauccugaccguggaagagaugacaaauucccgguuuccuauuccccuugaaaagcuguucaccgggccgagcucugccuucgucgugcagccucagaacggacgcuguacaaccgacggcguucuccuggggacgacacaacugucccccgugaauaucugcaccuuuagaggagaugucacacacaucgcuggcagccggaacuauaccaugaaucucgcgucucugaacuggaauaacuacgacccuaccgaggagauucccgccccucuuggcacacccgauuucguggggaaaauccagggaguccugacgcagaccacaaagggcgacggguccacccgcggacauaaagcuacaguguauaccggcagcgccccguuuacgccuaagcucggguccguucaguucucuacagacaccgaaaaugauuuugagacccaccaaaacacaaaguucacccccgugggagucauucaggacggcggcacaacgcacagaaaugaaccccagcaaugggugcugccuagcuacuccgggcggaacguuccgaaugugcaucuugcccccgcugucgccccuaccuuucccggagagcagcuccuguucuuucgcagcacaaugccuggcuguucuggguaccccaacauggaucuggacugccugcucccucaggaaugggugcagcacuucuaucaagaggcggcucccgcccaguccgauguggcccugcuuagauuuguuaauccggacaccggacggguccuguucgaguguaaacuccauaagagcggcuacgugacaguggcucacaccgggcagcacgaucuggucaucccucccaacggcuauuuucgcuucgacucuugggugaaccaguucuacacgcuugccccuaugggaaauggcaccgggagacggagauga

SEQ ID NO: 30177 - RNA, 1617 nt, Artificial Sequence
  derived and/or modified sequence opt5 from VP1__Norovirus_and/or_Norovirus-like__KM982942
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacaucggaucugcugauuuugccccuaagcugggccgcgugcaauucgagacggacacaaaccacgauuuugaagccaaucagaacaccaaauucacccccguuggggugauucaggacggaggcacaacccacagaaaugagccccaacaguggguccucccuagcuacuccggccggaacacaccgaaugugcaucuggcucccgccguggcgccuacguuucccggggaacagcuucuguucuuucgcagcaccaugccuggauguucuggcuaucccaacauggaucucgacugccugcugccucaggaguggguucaauacuucuaucaggaggcugcccccgcccaguccgaugucgcucuccugagauuugugaauccggacacagggcgggugcuuuucgaauguaagcugcacaaaagcggauacgucaccguggcccauacaggccagcacgaucucguuaucccucccaacggguauuuuagauucgacucucgcgugaaccaauucuacacccuggcuccuaugggcaauggaacgggccggagacgcuga

SEQ ID NO: 30178 - RNA, 1617 nt, Artificial Sequence
  derived and/or modified sequence opt5 from VP1__Norovirus_and/or_Norovirus-like__KJ685417
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugauccauaucuccggcagcagaaacuacacaaugaaucucgccucccagaacuggaacucuuaugauccuaccgaggaaauucccgcuccucugggcacccccgacuucgucgggaaaauccagggagugcuuacacagacgacccggacagacggcagcacccgcgggcacaaggcgacaguuuacaccggauccgccgauuuuagcccgaagcugggcagagugcaauucgcuacggacacagauaaugacuuugucaccaaucagaacaccaaauucacaccuguggggguuauucaggauggaucuaccacaccccggaaugagccccaacagugggugcucccuuccuacagcggccgcaacacgcauaauguccaccuggccccggccguggcucccaccuuuccuggcgaacagcuucuguucuuuagaucuacaaugcccggguguagcggauauccuaacauggaccucgauugccugcugccccaggagugggugcaauacuucuaucaggaagccgcgccugcucaguccgacguugcccuccugcgguuugucaaucccgauaccggcagagugcuuuucgaguguaagcugcacaaaucuggguacgugacagucgcccauaccggacagcacgaccucgugaucccgccuaacggcuauuuucgcuucgauagcuggguuaaccaauucuacacgcuggcucccauggggaauggcaccggacggagacgcuga

SEQ ID NO: 30179 - RNA, 1617 nt, Artificial Sequence
  derived and/or modified sequence opt5 from VP1__Norovirus_and/or_Norovirus-like__KC907392
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagaagccccauuccgcuugagaagcuguuuacagggccuucuuccgccuucgucgugcagccccagaacggacgguguaccacggauggcguucuccuggggacaacccaacugagcccugugaauaucugcacauuccgcggagacgucgcccauaucgcuggcacccagaacuacaccaugaaucucgcgucucagaacuggaauaacuaugaucccacagaggaaauuccugcuccccugggcacgccgaauuuuguggggaaaauccagggaguccuuacccaaacaaccaagagagacggcuccacacgggggcgcaaggccaccgugagcacgggauccguucacuucacaccuaaacugggcucugugcaguuuagcaccgacaccuccaacgauuucgagacagggcagaauaccagauuuacacccgucggagugguucaagacggcagcacgacccaucggaacgaaccccagcagugggugcucccugauuacucuggccgcgacucccacaauguccaccuggccccggccguggcucccacauucccuggggagcagcuucuguuuuucagaagcucuaugcccggauguagcggcuacccuaacauggaucucgacugccugcugccccaagaaugggugcagcauuuuuaucaggaguccgccccugcgcagucugauguugcucuccugcgguucgucaaucccgacaccgggagagugcuuuuugaguguaagcugcacaaaagcggauacgugacagucgcccauaccggccaacacgaucucgugauuccgccuaacggguauucccgcuucgacagcuggguuaaccaguuuuacacgcuggcccccaugggcaauggagcuggccggagacgcuga

SEQ ID NO: 30180 - RNA, 1617 nt, Artificial Sequence
  derived and/or modified sequence opt5 from VP1__Norovirus_and/or_Norovirus-like__KC517377
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguaugcuccccuucgcgccaacaacgccggcgaugacguguucaccgucuccugcagagugcugacacggccuagcccggauuuugacuucauuuuucucguucccccuaccguggaaucucgcacaaaacccuucuccgucccugugcugaccguugaggaaaugacgaauagcagauuucccaucccgcuugagaagcuguucaccgggccuucuuccgcuuucgugguccagccccagaacggacgguguacaaccgauggcgugcuccuggggacaacccaacugagcccugucaauauuugcacguuucgcggagacgugacacauaucaccggcucuagaaacuacacaaugaaucucgcgucccagaacuggaauaacuaugaucccaccgaggaaauuccugcuccccugggcaccccggacuucguugggaaaauccagggagugcuuacacagacgacccggacagacggcagcacccgcgggcacaaggccacagucuacaccggauccgccgauuuugccccuaagcugggcagagugcaauucgagacggacacagaucaugacuuugaagcuaaucagaacaccaaauucacccccguuggggugauccaggauggaggcacaacccaccggaaugagccccaacaguggguccucccuucuuacagcggccgcaacacacacaaugugcaucuggccccggcgguggcucccacguuuccuggggaacagcuucuguucuuuagauccaccaugcccggauguagcggcuauccuaacauggaccucgauugccugcugccccaggaguggguucaauacuucuaucaggaggccgccccugcucagucugacgucgcccuccugcgguuugugaaucccaacacagggagagugcuuuucgaauguaagcugcacaaauccggauacgucaccguggcucauacaggccagcacgaucucguuauuccgccuaacgacuauuuucgcuucgauagcugggugaaucaauucuacacccuggcccccauggggaacggcacgggacggagacgcuga

SEQ ID NO: 30181 - RNA, 1617 nt, Artificial Sequence
  derived and/or modified sequence opt5 from VP1__Norovirus_and/or_Norovirus-like__KC517368
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucgcccaggcgcccggcggggaauuuaccguuagcccucggaacgcccccggagagauucugugguccgcuccucuuggcccggaucugaaucccuaccucucucaccuggcccgcauguauaacggguacgcuggaggcuucgaagugcaggucauccuugccgagaaugcguuuacagccggcaaaauuaucuucgcugccgugccucccaacuuuccuacggaggggcugagccccuccagaguuaccauguucccgcauaucauuguggacguccggcagcucgaaccugugcugaucccccugccugaugugcgcaauaacuuuuaucacuacaaucaaucuaacgacagcacaauuaagcucaucgcuaugcuguauacaccccuuagagccaacaaugccggagaggaugucuucaccguuuccugccgggugcugacccgccccagcccugacuuugauuucauuuuucucgugccgcccacagucgaaucuagaaccaaaccuuucacggugcccauccugaccguugaggagacaaccaacucccgguuuccuauuccccuugaaaagcuguucacaggcccgagcucugcuuucgugguccagccucagaaugggcgcuguaccacggacggagugcuccugggcacaacccagcugucccccguuaacaucugcacauuuagaggggaugugacccauaucgcgggaagccggaauuacaccaugaaccucgccucucugaauuggaacaauuaugucccuacagaggaaauucccgcuccucuuggcacgcccgacuucgugggcaaaguccaagggaugcugacccagacaaccaagggagauggcuccacacgcgggcacaaggccaccguguacacgggaagcgccccguuuacaccuaaacucggcuccguucaguucgagaccgacaccgaaaacgacuuugagacacaucagaauaccaaguucacacccgugggggucauccaagauggaggcacgacccacagaaacgagccccagcagugggugcugccuucuuacagcggccggaauguuccgaacgugcaccuugcucccgccgucgcgccuacauuucccggggaacaacuccuguucuuucgcuccaccaugccuggauguagcggcuaucccaauauggaccuggauugccugcucccucaggagugggugcagcauuucuaccaggaagcugcccccgcccaaucugacguggcucugcuuagauuuguuaacccggauacagggcggguccuguucgaguguaaacuccacaaguccggauaugugaccguggcccauacgggccagcacgaccuggucauuccucccaacggguacuuuagauucgauagcugggugaaucaguucuauacccuugcuccuaugggcaacggaacaggccgccggagauga

SEQ ID NO: 30182 - RNA, 1617 nt, Artificial Sequence
  derived and/or modified sequence opt5 from VP1__Norovirus_and/or_Norovirus-like__AB541310
augaagaugagaagcuccgacgccaaccccucugauggcagcaccgcuaaucuggugccugaggucaacaaugaaguuauggcccucgagccgguggugggggcggcuaucgccgcccccgucgcuggacagcaaaacgugauugacccuuggauccggaauaacuucguucaggcccccggcggggaauuuacaguguccccucgcaaugcucccggagagauucuguggucugccccucuuggcccggaucugaaccccuaccucagccaccuggcgagaauguauaauggguacgccggaggcuucgaaguccaggugauccuugcuggcaacgccuuuacggcugggaaaauuaucuucgccgcgguuccucccaauuuuccuaccgagggacugucccccucucaggugacaauguucccgcauaucauugucgacgugcggcaacucgagccugugcugaucccccugccugauguccgcaacaauuuuuaucacuacaaccagagcaaugaccccaccauuaagcucaucgccaugcuguauacaccccuuagagcuaacaacgccggcgaugacguuuucaccggguccugccgggugcugacacgcccuagcccggauuuugacuucauuuuucucgugcccccuaccgucgaaucuagaacgaaacccuucuccgugagcuuuuucaccggagaggaaaugacaaauucucgguucccuaucccccuggagaaacuuuuuaccggcccguccagcgcuuucguugugcagccucagaacgggcgcuguacaaccgauggaguccugcucggcacgacacaacugucucccgugaauauuugcaccuuuagaggcgacguuacacauaucaccgggucccggaacuacaccaugaaucuggccacacagaacuggaauagcuaugauccuacggaggaaauccccgccccucucggaacccccgacuucgugggcaagauucaggggguccugacacagaccacacgcgcugacggauccaccagaggccacaaggcgacgguguacacagggucugccgauuuugcuccgaaacuuggacggguccaauucgccaccgacaccgauaacgacuuugaugccaaucagaacacaaaguucaccccugugggcguuauccaggacggcgauacagcucaucgcaaugagccccaacagugggugcugcccagcuacuccgggagaaacagccacaauguccaccucgccccugcgguggcuccgacguuucccggagaacagcugcuuuucuuucggucuaccaugccuggcuguuccggguaucccaacauggaccuggauugccuccugccucaggaguggguucaauacuucuaucaggaagccgcccccgcucagagcgacguggcccugcucagauuugucaauccugauacaggacgcgugcuguucgaguguaaacuucauaagucuggcuacgugaccguugcucacacagggcagcaugaccuggucauucccccgaacggcuauuuccgguuugacagcugggugaaccaauucuacacccucgccccuaugggaaauggcacggggagacgccgguga

SEQ ID NO: 30183 - RNA, 1617 nt, Artificial Sequence
  derived and/or modified sequence opt5 from VP1__Norovirus_and/or_Norovirus-like__EF535854
augaagauggccaccaacgacgcuagccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaagucgaggugauccuugccggcaacgcuuuuaccgccgggaaaauuaucuucgcggccguuccucccaauuuuccuacagagggacugagccccucccaggugaccauguucccgcauaucauugucgacgugagacagcucgaaccugugcugaucccccugccugauguccggaacaauuuuuaucacuacaaccaaucuaaugacagcacaauuaagcucaucgcuaugcuguauaccccucuucgcgccaacaacgcuggcgaugacguuuucacaguguccugcagagugcugacccggcccagcccugauuuugacuucauuuuucucgucccgcccacgguggagucucgcaccaaaccuuucacaguucccauccugaccguggaagagaugacaaauuccagauuuccuauuccccuugagaagcuguucaccgggccgagcucugcccucgucgugcagccucagaacggacgguguacgacagauggcguucugcuggggaccacacagcucucccccgugaauaucugcaccuuccgcggagacgucacccauaucagcggcacaagaacguaccggaugaaccuggccucucaaaauuggaacaauuaugauccuaccgaagagauucccgcuccucuuggcacacccgacuuuguggggaaaauccagggaaugcugacccagacaaccaagggcgacggguccacgcgcggacacaaggcgacagucagcaccggcuccguggauuucaccccgaaacucgggucuguucaguuugccacagacaccgauaacgacuucgaaacaggacaaaauacgagauuuaccccugugggcgucauucaggauggcagcuccgcucaucggaacgagccccagcaaugggugcugcccgacuacagcgggcgcacaguucacaaugugcaccuugccccugccgucgcuccgaccuuccccggagaacagcugcccuuuuucagaucuacaaugcccggcuguuccggguacccuaacauggaucucgacugccugcugccccaggagugggugcagcauuuuuaucaagaggccgcgccuagccagucugauguggcucuccugcgguucguuaaucccgacaccggaagaguccuuuuugaauguaagcugcacaaagccggcuacgugacgguggcccauaccgggcagcacgaucucgucaucccgccuaacggcuauuuccgcuuugacagcugggugaaucaguccuacacacuggcucccaugggaaacggcgccgggcggagacgcuga

SEQ ID NO: 30184 - RNA, 1617 nt, Artificial Sequence
  derived and/or modified sequence opt5 from VP1__Norovirus_and/or_Norovirus-like__KX514368
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccggcaauuccaaaaucuacaccaugaaccucgcuagcccuaauuggaacaauuaugaccccacagaggagaucccugcgccccugggcaccccggacuucgucgggaagauucagggaaugcuuacccagacaacgaagggcgaaggguccaccagaggacaccgggccacaguguacguuggcucugcuaacuacgccccuaaacuggggcgcgugcaguuugagaccgauacaaccgacgaucucgacgcccaucaaaauacgaaguucacacccgucggagugguucagggcggcgaaagccccaaaggguccgagccucagcaaugggugcugccgagcuauucuggaagagauacccccaacguccaccuugcuccugccguggcgcccaccuuuccuggcgaacagcuccuguucuuucgguccacaauccccggguguggaggccacccuaauaugaaccuggacugccugcucccccaggagugggugcagcauuucuaccaagaggcugccccggcccagagcgauguugcucugcuucgcuuugucaauccugacaccucuagagugcuguucgaauguaagcuccacaaaagcggguaugugacagucgcccauacgggccagcacgaucuggugauucccccuaacggauacuuucgguucgacuccuggguuaaccaguuuuauacccuugcucccaugggcaaugggacaggaagaaagcgcuga

SEQ ID NO: 30185 - RNA, 1617 nt, Artificial Sequence
  derived and/or modified sequence opt5 from VP1__Norovirus_and/or_Norovirus-like__KX514351
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggggcugaaucccuaccucucucaccuggcccgcauguauaacggauacgcuggcggcuucgaaguccaggugauccuugccgggaaugcuuuuacggccggaaaaauuaucuucgcggccguuccucccaacuuuccuaccgagggccugaaucccagccaggugacaauguucccgcauaucauugucgaugugagacaacucgagccugugcugaucccccugccugacguccggaacaauuuuuaucacuacaaccaguccaacgauucuaccauuaagcucaucgcuaugcuguauacaccccuucgcgccaauaacgcuggggacgauguuuucaccgugagcugcagagugcugacacggcccuccccugacuuugauuucauuuuucucgucccgcccaccguggaaagccgcucuaaaccuuucuccguucccgugcugacgguccaggagaugaccaauagcagauuuccugccacacuugacaagcuguucaccggacccucuuccaaccucgugguucagccgcaaaauggccgguguaugaucgauggggugcugcugggaacaacccagcucagcccugucaacauuugcacguuccgcggcgacgugacacaucugagagauucuaccaucuacacaaugaaucuugccucccccaacuggaauaacuaugacccuaccgaagagauccccgcuccucugggcacccccgacuuugucgggaaaauucagggagugcucacacagacgaccaagggcgaggggagcacacggggacaccgcgcgaccguuuacgugggcuccgccaauuacacaccgaagcuggggaaaguccaauucgaaaccaacacgacaaaugaucuuuaugcucaucagaacaccaaguuuaccccugugggaguugugcagggcggcgagucugcccacagaagcgaaccccaacaguggguccugcccggguucuccggacgggacacaccuaaugugcaccucgccccggcuguggcccccaccuuuccuggcgagcagcugcuguucuuucgcagcacaauccccggguguggaggccauccuaacauggaucucgacugccugcuuccccaggaauggguucaacacuucuaccaggaggcggcuccugcccagucugaugucgcccugcucagauuugugaaccccgacacgucccgggugcuguucgaguguaaacuucauaagagcggguaugucaccguggcucacacaggccagcacgaucugguuauuccgccuaauggauacuuuagauucgacucuugggugaaccaauuuuauacccucgcccccaugggcaaugggacaggacgcaaacgguga

SEQ ID NO: 30186 - RNA, 1617 nt, Artificial Sequence
  derived and/or modified sequence opt5 from VP1__Norovirus_and/or_Norovirus-like__KC517372
augaagauggccagcaacgacgcuaaucccuccgauggcucugccgugaaccuggucccugagguuaauaacgaagugauggcgcucgagccgguggucggggcugccaucgccgcucccguggccggacagcaaaauguuauugacccuuggaucagaaacaauuucgugcaggcucccggcggggaauuuaccgucagcccucggaacgcccccggagagauucugugguccgcgccucuuggcccggaucugaaucccuaccucucucaccuggcccgcauguauaacggguacgcuggaggcuucgaagugcagguuauccuugccggcaaugcuuuuacagccgggaaaauuaucuucgcggccgugccucccaacuuuccuacggagggacugagccccucccaggucaccauguucccgcauaucauuguggacgcuagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucgcucauaucgcgggcagcagaaauuacacaaugaaccucgccucucugaauuggaacaauuaugacccuaccgaagagauucccgcuccucuuggcacccccgauuucguggggaaaauccagggaaugcugacacagacgaccaagggcgacggguccacacggggacacaaggccaccgucuacacaggcagcgccccguuuaccccuaaacucggguccgugcaguucgaaacggacacagagaacgauuuugaaacccaucaaaauaccaaguucacacccguuggagugauucaggacggcggcaccacacaccgcaacgagccccagcaauggguccugccuucuuacagcgggagaaaugugccgaacguucaccuugcucccgccguggcgccuacguuucccggagagcagcugcuccuguuccgguccaccaugccuggcuguagcggguaucccaauauggaucuggacugccuccugccucaggaauggguccagcauuuuuaccaagaggcugcccccgcccagucugauguggcccuucugcgcuucgugaacccggacacaggaagaguucucuuugaauguaaacugcacaaguccggcuaugucaccguggcucauacagggcagcacgaucuugugaucccucccagcggcuacuuccgguuugacucuugggucaaccaguucuauacccuggcuccuaugggaaauggcacggggagacgccgguga

SEQ ID NO: 30187 - RNA, 1617 nt, Artificial Sequence
  derived and/or modified sequence opt5 from VP1__Norovirus_and/or_Norovirus-like__JN400613
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguuccgggggcgcagcucugcccucgucgugcauccgcagaauggaagauguaccacagacggcguucugcuggggaccacgcagcucuccccugugaacaucugcacauuccggggagaugucacccacaucgcuggcagccauaauuacacaaugaaccuggcgucucuuaauuggaacaauuaugaccccaccgaagagauuccugcuccccugggcaccccugauuuuguggggaaaauccaaggaguccucacacagacgaccaagggcgacggguccacacgcggacacaaggccaccguguacacaggcagcgcccccuucaccccgaaacugggguccguucaguuuucuacggacacagaaaacgauuucgagacccaccagaauaccaaguuuacaccugugggagucauucaagacggcagcaccacacauagaaacgaaccccagcagugggugcuucccuccuacagcggcgggaauguucacaacgugcaucuggccccugcugucgccccgacguuccccggagagcaacuccuguuuuuccggucuaccaugccuggcuguuccggguaucccaauauggaucuggacugccuccugccucaggagugggugcagcacuuuuaccaggaagcggcucccgcccaaagcgauguggcccuucugcgcuucguuaacccugacacaggaagaguccucuuugaguauaaacugcacaagucugauuacgugaccguggcucauacaggccagcacgaccuugucauucccccgaacggguauuuccgguuugauagcugggugaaucaguucuacacccuggccgcuaugggcaacggaacgggcagacgccgguga

SEQ ID NO: 30188 - RNA, 1617 nt, Artificial Sequence
  derived and/or modified sequence opt5 from VP1__Norovirus_and/or_Norovirus-like__KX514291
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucaccggcaaaauucaggggaugcuuacacagacgaccaagggagaaggcuccacacgggggcaccgcgccaccgucuacgugggaucugcuaauuacgcccccaagcugggcagaguucaguuugagacagacaccacgaacgaucucgacgcccaucaaaauacaaaauucacccccgugggggucauccagggaggcgaaagcgcucaccgguccgagccucagcaaugggugcugccgagcuauucuggccgcgauacccccaacguucaccuugccccugcgguggcucccacauuuccuggggaacagcuccuguucuuuagauccaccauucccggauguggcgggcauccuaauaugaaccuggacugccugcucccccaggaguggguccagcacuucuaccaagaggccgccccggcucagagcgauguggcccugcuucgguuugugaauccugacacaucuagaguucuguucgaauguaagcuccauaaaagcggauaugucacgguggcucacaccggccagcacgaucuggugauucccccuaacggguacuuucgcuucgacuccugggucaaccaguuuuauacacuugcccccaugggcaauggaaccggccggaagagauga

SEQ ID NO: 30189 - RNA, 1617 nt, Artificial Sequence
  derived and/or modified sequence opt5 from VP1__Norovirus_and/or_Norovirus-like__KX514219
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgacacaaccaacgaucucgacgcccaucaaaauacgaaauucacacccgucggggugguucagggaggcgaaagcccucagcgguccgagccgcaacagugggugcugcccagcuauucuggccgcgauaccccuaacguccaccuugcucccgccguggcgccuaccuuucccggggaacagcuucucuucuuuagauccacacugccuggauguggcgggcaccccaauauggaccuggauugccuccugccgcaggagugggugcaacauuucuaccaggaggcugccccugcccagagcgacguugcucugcugcgguuugucaaccccgauaccucuagaguccucuucgaauguaagcugcacaaaagcggauaugugacaguggcccauacgggccaguacgaccuugugcugccuuccaauggguauuuucgcuucgauucuuggguuaaccaauuuuacacccucgcucccaugggcaacggaacaggccggagacgcuga

SEQ ID NO: 30190 - RNA, 1617 nt, Artificial Sequence
  derived and/or modified sequence opt5 from VP1__Norovirus_and/or_Norovirus-like__AB933668
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacaguugugaaaacgacccugagcgcggucccucccaacuucccuacagaggggcucucccccucucaggugaccauguuuccgcauauuaucguggacgucagacaacuggagccuguucugaucccccucccugaugugcggaauaacuucuaucacuacaaucagagcaacgacuccacaauuaagcugaucgccaugcuuuauacaccccugcgcgcuaacaaugccggagaagauguguuuaccgucagcugcagagugcucacccggcccucuccugacuucgauuuuauuuuccugguuccgcccacgguggagucccgcaccaaaccuuuuacaguccccauccuuaccguggaagagaugacaaacagcagauucccuauuccccuggagaagcucuuuaccggcccgucuuccgcuuucguugugcagccucagaaugggcgguguacgacagacggaguccugcugggcaccacacaacucagccccgugaacaucugcaccuuccgcggggaugucacccauauugccggaucuagaaauuacacaaugaaccuggccucccuuaauuggaacaauuaugacccuacggaagagauccccgcuccucugggcacccccgauuuugugggcaaaauccaggggguucucacacagaccacaaagggagacggcagcacccgggggcacaaggcgacgguguacacaggauccgccccguucaccccuaaacugggcucuguccaguuuagcaccgacacagaaaacgauuucgagacccaucaaaauacaaaguuuacgcccguggggguuauucaggacggaggcaccacacaccgcaacgaaccccagcaaugggugcuuccuuccuacagcggcagaaaugucccgaacgugcaccuggcucccgccguggccccuaccuuccccggggagcagcuccuguuuuuccggucuacaaugccuggauguuccggcuaucccaauauggaucuggacugccuccugccucaggaguggguucagcauuuuuaccaagaagcugcccccgcgcagagcgaugucgcccuucugcgcuucgugaacccggacaccgggagagugcucuuugaguguaaacugcacaagucuggauaugucacgguggcucauaccggccagcacgaucuuguuaucccucccaacggguacuuccgguuugacagcugggugaaucaguucuauacacuggccccuaugggcaacggaaccggcagacgccgguga

SEQ ID NO: 30191 - RNA, 1617 nt, Artificial Sequence
  derived and/or modified sequence opt5 from VP1__Norovirus_and/or_Norovirus-like__KJ678149
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccauuuccccucggaaugcgcccggagagauccuguggucugccccucuuggcccggaucugaaccccuaccucagccaccuggcucgcauguauaauggguacgccggaggcuucgaagugcaggucauucuugcuggcaacgccuuuacagcggggaaagugaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaugacuccacaaucaagcucauugccaugcuguauacaccccuucgcgcuaacaacgccggcgaugacguguucaccgugagcugcagaguccugacccggcccucuccugauuuugaccucaucuuccuggugccgcccacaguugaaucccgcaccaaaccuuuuagcgugcccguccuuacgguggaggaaaugaccaauucuagauucccuacaccccuggagaagcucuuuaccgggccguccagcgccuucguugugcagccucagaacggacgguguacaaccgauggcguccugcuggggacgacacaacucucucccgugaauauuugcaccuuccgcggagacgucacacauaucaccggcuccagaaacuacaccaugaaucuggcuagccagaacugguccaauuaugauccuacagaggaaauucccgcgccucuuggcacgcccgacuuuguggggaaaauccagggaguucugacccagacaacccggacagacggcucuacccgcgggcacaaggccacgguguacacaggaagcgcugauuucgccccgaagcucggcagaguccaauuugagaccgacaccgaucaugacuucgaaacaaaccagaauaccaaauuuacaccuguggggguuauccaggauggauccacgacccaccggaacgagccccaacagugggugcugcccagcuacucuggccgcaauacaccuaacguccaccuugccccggcuguggcccccaccuucccuggcgaacagcugcucuuuuucagauccacaauucccggguguagcggauauccuaauauggaccuggauugccugcucccccaggagugggugcaauacuuuuaucaggaggcggcuccugcccagucugacguugcccugcuucgguucgucaaccccgauaccggcagagugcuguuugaauguaagcuccauaaaagcggguacgugacggucgcucacaccggacagcaugaccuggugaucccgccuaauggcuauuuccgcuuugauuccuggguuaaccaauucuacacacuugcccccauggggaacggcaccggacggagacgcuga

SEQ ID NO: 30192 - RNA, 1617 nt, Artificial Sequence
  derived and/or modified sequence opt5 from VP1__Norovirus_and/or_Norovirus-like__KP244318
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauucgcaccuuuagaggagacgugacacauauccccggcucucggaacuacaccaugaacuccgccagccagaauuggaacuccuaugauccuaccgaggaaauccccgcuccgcucggcacaccugacuucgucgggaaaauucagggagugcugacgcagaccacacgcgcgaauggcucuaccagagggcacaaggccacaguuuacaccggaagcgcugacuuuucccccaaacuuggccgggugcaauucgccacggauacagacaaugauuuugagaccaaccagaauaccaaguucacacccgucggggugauccaggacggaagcaccacaccucgcaacgaaccgcaacaguggguucugcccucuuacuccggcagaaauauucauaacgugcaccucgccccugcugucgcccccacguuuccuggcgagcagcugcuuuucuuucggagcaccaugcccgggugcucuggauauccuaauauggaucuggacugucuccugccccaggaaugggugcaauacuucuaucaggaggcggcuccggcccagagcgauguggcccugcucagauuuguuaacccugacacaggccgcguccuguucgagugcaaacuucacaaguccggguacgugaccguggcucauacaggacagcacgaucuggucauucccccuaacggcuauuuucgguucgacucuugggugaaucaauucuacacccucgcccccauggggaacggcacgggaagacgccgguga

SEQ ID NO: 30193 - RNA, 1617 nt, Artificial Sequence
  derived and/or modified sequence opt5 from VP1__Norovirus_and/or_Norovirus-like__KX514362
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccggcggcuccaaaaucuacaccaugaaucucgcuagcccuaacuggaauaacuaugaccccacagaggagaucccugcgccccuggggaccccggacuucgucggaaagauucagggcaugcuuacccagacaacgaagggggaaggauccaccagaggccaccgggccacaguguacguugggucugcuaauuacgccccuaaacugggacgcgugcaguuugagaccgauacaaccgacgaucucgacgcccaucaaaacacgaaguucacacccgucggcgugguucagggcggggaaagccccaaaggauccgagccucagcaaugggugcugccgagcuauucuggcagagauacccccaauguccaccuugcuccugccguggcgcccaccuuuccuggggaacagcuccuguucuuucgguccacaauccccggauguggcgggcacccuaacaugaaucuggacugccugcucccccaggagugggugcagcauuucuaccaagaggcugccccggcccagagcgauguugcucugcuucgcuuugucaacccugacaccucuagagugcuguucgaauguaagcuccacaaaagcggcuaugugacagucgcccauacgggacagcacgaucuggugauucccccuaauggcuacuuucgguucgacuccuggguuaaccaguuuuauacccuugcucccauggggaacggaacaggcagaaagcgcuga

SEQ ID NO: 30194 - RNA, 1617 nt, Artificial Sequence
  derived and/or modified sequence opt5 from VP1__Norovirus_and/or_Norovirus-like__KX514329
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacgccccuucgcgcuaacaacgccggcgaugacguuuucacagugagcugcagagugcugacccggcccucuccugauuuugacuucauuuuucucgucccgcccacaguggaaucccgcagcaaaccuuucucuguucccgugcugaccgucgaggaaaugaccaauuccagauuuccugccacccuugauaagcuguucacagggcccagcucuaccuucgugguucagccgcagaacggacgguguaugaucgacggcgugcuccuggggacaacccaacuguccccugucaauauuugcacguuucgcggagaugugacacauagcggcaacuccaaaaucuacaccaugaaucucgcuucucccaacuggaauaacuaugacccuacagaggagauccccgcgccucugggcacccccgacuucgucgggaagauucagggaaugcuuacccagacaacgaagggcgaagggagcaccagaggacaccgggccacaguguacguuggcuccgcuaauuacgccccgaaacuggggcgcgugcaguuugagaccgauacaaccgacgaucucgacgcccaucaaaacacgaaguucacaccugucggagugguucagggcggcgaaagccccaaagggucugagccccagcaaugggugcugccuuccuauagcggaagagauaccccgaauguccaccuugcucccgccguggcgccuaccuuucccggcgaacagcuccuguucuuucggucuacaaucccuggguguggaggccaccccaacaugaaucuggacugccugcucccucaggagugggugcagcauuucuaccaagaggcugcccccgcccagagcgauguugcucugcuucgcuuugucaacccggacaccuccagagugcuguucgaauguaagcuccacaaaucuggguaugugacagucgcccauacgggccagcacgaucuggugauuccucccaauggauacuuucgguucgacagcuggguuaaccaguuuuauacccuugcuccuaugggcaacgggacaggaagaaagcgcuga

SEQ ID NO: 30195 - RNA, 1617 nt, Artificial Sequence
  derived and/or modified sequence opt5 from VP1__Norovirus_and/or_Norovirus-like__KJ678152
augaagauggccagcuccgacgcuaaccccugcgauggcucugccgcgaaucuggugccugaggucaacaaugaaguuauggcucucgagccgguggugggggccgccaucgcugcccccgucggaggccagcaaaacgugauugacccuuggaucagaaauaacuucguucaggcucccgggggagaauuuaccgugagcccucggaaugcccccggcgagauucugugguccgcgccucuugggccggaucugaaccccuaccucucucaccuggcccgcauguauaauggauacgcuggcggcuucgaaguccaggugauccuugccgggaacgcuuuuacagccggaaaaguuauuuucgcggccgugccucccaauuuuccuacggagggccugagccccucccaggucaccauguucccgcauaucgugguggacgucagacaacucgagccuguucugaucccccugccugaugugcggaacaauuuuuaucacuacaaccagucuaaugacagcacaauuaagcucaucgcuaugcuguauacaccccuucgcgccaacaacgcuggggaugacguguucaccgucuccuguagagugcugacccggcccagcccugauuuugacuucauuuuucucguuccgcccacaguggaaucucgcaccaaaccuuucuccguccccgugcugacgguugaggaaaugaccaauagcagauuuccuacaccccuugagaagcuguucaccggaccgucuuccgccuucgugguccagccucagaacggccggugcacaaccgauggggugcuccugggaacgacacaacugagccccgucaauaucuguaccuuucgcggcgacgugacacauauuaccggcucuagaaacuacaccaugaaucucgccucccagaacuggagcaauuaugauccuacagaggaaauccccgcuccucuggggacgcccgacuucguuggaaaaauucagggcgugcuuacccagacaacccggacagacggguccacccgcggacacaaggcgacggucuacaucggcucugccgauuuugcuccgaagcuggggagagugcaauucgagacagacaccgaucaugacuuugaaaccaaccagaauacaaaauucaccccuguuggagugauccaggauggcagcacaacgcaccggaacgagccccaacaguggguccuccccuccuacagcggccgcaauaccccuaacgugcaccuggccccggccguggcucccacauuuccuggggaacagcuucuguucuuuagaucuacccuccccggaugcuccggcuauccuaauauggaccuggauugucugcucccccaggaguggguucaauacuucuaucaggaggccgcgccugcucagagcgacgucgcccugcuucgguuugugaaccccgauacagggagagugcuguucgaaugcaagcuccauaaaucuggauacgucaccguggcccacacgggccagcaugaccugguuauuccgccuaauggguauuuucgcuucgauagcugggugaaccaauucuacacccuugcucccaugggcaacggaacaggccggagacgcuga

SEQ ID NO: 30196 - RNA, 1617 nt, Artificial Sequence
  derived and/or modified sequence opt5 from VP1__Norovirus_and/or_Norovirus-like__KX514352
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgacacaaccaacgaucucuaugcccaucaaaauacgaaauucacacccgucggggugguucagggaggcgaaagcgcucaccgguccgagccucagcaaugggugcugccgggcuacagcgggcgcgacacccccaacguccaccuugccccugcgguggcucccaccuuuccuggagaacagcuccuguucuuuagaucuacaauccccggcugugggggacauccuaauauggaucuggacugccugcucccccaggagugggugcagcacuucuaucaagaggccgccccggcucaguccgauguugcccugcuucgguuugucaacccugacaccagcagagugcuguucgaauguaagcuccauaaaucuggcuacgugacagucgcucacacggggcagcacgaucuggugauucccccuaauggcuauuuucgcuucgacagcuggguuaaccaguuuuacacccuugcccccaugggaaacggcacagggcggaagagauga

SEQ ID NO: 30197 - RNA, 1617 nt, Artificial Sequence
  derived and/or modified sequence opt5 from VP1__Norovirus_and/or_Norovirus-like__KX514339
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcagcaaaccuuucucuguucccgugcugacggucgaggaaaugaccaauuccagauuuccugccacacuugauaagcuguucaccgggcccagcucuacauucgugguucagccgcagaacggacgguguaugaucgacggcgugcuccuggggaccacgcaacuguccccugucaauauuugcacauuucgcggagaugugacccagagcggcaacacaaaaaucuacaccaugaaucucgccucccccaacuggaauaacuaugacccuaccgaggagauccccgcuccucugggcacacccgacuucgucgggaagauucagggaaugcuuacgcagaccacaaagggcgaagggucuaccagaggacaucgggcgacaguguacguuggcagcgccaauuacgcuccgaaacuggggcgcgugcaauuugagaccgauacgacagacgaucucgacgcccaccagaacaccaaguucaccccugucggagugguucagggcggcgaaucccccaaagggagcgagccccaacagugggugcugccuucuuauuccggaagagauacaccgaauguccaucuugcccccgcuguggccccuaccuuucccggcgaacagcuccuguucuuucggagcacaaucccuggguguggaggccaccccaacaugaaucuggacugccugcucccucaggagugggugcaacacuucuaccaggaggcggcucccgcccagucugauguugcccugcuucgcuuugucaacccggacacgagcagagugcuguucgaauguaagcuccauaaauccggguaugugaccgucgcucacacaggccagcaugaucuggugauuccucccaauggauacuuucgguucgacucuuggguuaaccaauuuuauacccuugccccuaugggcaacgggacaggaagacgccgguga

SEQ ID NO: 30198 - RNA, 1617 nt, Artificial Sequence
  derived and/or modified sequence opt5 from VP1__Norovirus_and/or_Norovirus-like__KR904238
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauccaggauggaagcaccacacaccggaaugagccccaacagugggugcuccccuccuacagcggccgcaacacgcacaauguucaucuggcuccugccguggcgccgaccuuucccggcgaacagcuuccuuucuuuagaucuacaaugcccggguguuccggauauccuaacauggaccuggauugccuccugccccaggaguggguccaauacuucuaucaggaggcugccccugcccagagcgacguggcucugcuccgguuugugaaucccgauaccggcagaguucuguucgaauguaaacuucacaagucuggguacgucacaguggcccauaccggacagcacgaccuggugauuccgccuuauggcuacuuucgcuucgauagcugggucaaccaauucuauacgcucgcucccauggggaacggcaccggacggagacgcuga

SEQ ID NO: 30199 - RNA, 1617 nt, Artificial Sequence
  derived and/or modified sequence opt5 from VP1__Norovirus_and/or_Norovirus-like__KJ710245
augaagauggccagcuccgacgcuaaccccucugauggcagcaccgccaaucuggugccugaggucaacgacgaaguuauggcgcucgagccgguggugggggcugcccuggccgcucccgucgccggacagcaaaaugugaucgauccuuggauuagaaacaauuucguucaggcucccggcggggaauuuacaguguccccucggaacgcccccggagagauccuuuggucugcgccucugggcccggaccucaaucccuaccugagccaccuugcccgcauguauaacggguacgcuggaggcuucgaaguccaggugauucuggccggcaaugcuuuuacggccgggaaaguuaucuucgcggccgugccucccaacuuuccuaccgagggacucucccccucucaggucacaauguucccgcauauuaucguggaugugagacaacuggagccuguccugaucccccucccugacgcucggaauaacuuuuaucacuacaaucagagcaacgaauccaccauuaagcugaucgccaugcuuuauacaccccugcgcgcuaauaacgccggcgaugacguuuucaccgugagcugcagagugcucacacggcccucucuggauuuugacuucauuuuucuugucccuccgaccguggagucccgcacgaaacccuucagcguuccuauccugaccguggaagagaugacaaacucuagauuucccauuccucucgagcggcuguucaccgggcccuccagcgccuucgcuguccagccgcagaauggacgcuguacaaccgauggcgugcugcucgggacgacacaacugucuccuguuaacaucugcaccuuuagaggagacgugacacauaccaccggcucccacaauuacacaaugaaccuugcgagccagaaucgguccaacuaugaucccacggaagagauuccugcuccccugggcaccccugacuucgucgggaagauccagggagcccucacacagaccacacgcgccgacggcucuaccagagggcauaaagccacgguguacacaggaagcgcugauuuuacccccaagcugggccggguccaauucgccaccgacacagaucacgacuuugauaccaaucagaacacaaaguucacgccgguggggguuauccaggacggauccaccacacaccgcaaugaaccucaacagugggugcuucccagcuacucuggcagaaacacccauaauguccaccuggcgcccgcuguggccccuacauuuccgggcgagcagcuccuguucuuucgguccaccaugcccggguguagcggauauccuaacauggaucuggacugccuccugccccaggaauggguugcccauuucuaccaagaggcugccccugcucagucugauguggcccuucugagauuugucaaucccgacacgggccgcguucucuucgaguguaaacugcacaagagcggguaugugaccguggcgcacacaggacagcaugaucuugucauuccucccaacggcuacuuucgguucgacuccugggugaaucaguucuauacccuggccccgauggggaacggcacaggaagacgccgguga

SEQ ID NO: 30200 - RNA, 1617 nt, Artificial Sequence
  derived and/or modified sequence opt5 from VP1__Norovirus_and/or_Norovirus-like__KX514298
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgacacaaccaacgaucucgacgcccaucaaaauacgaaauucacacccgucggggugauccagggaggcgaaagcgcucaccgguccgagccucagcaauggguucugccgagcuauucuggccgcgauauucccaacgugcaccuugccccugcggucgcucccaccuuuccuggggaacagcuccuguucuuuagauccaccauccccggauguggcgggcauccuaauaugaaccuggacugccugcucccccaggagugggugcagcacuucuaccaagaggccgccccggcucagagcgauguggcccugcuucgguuuguuaauccugacacaucuagaguccuguucgaauguaagcuccauaaaagcggauaugugaccguggcucacacaggccagcacgaucuggucauucccccuaacggguacuuucgcuucgacuccugggugaaccaguuuuauacgcuugcccccaugggcaauggaaccggccggaagagauga

SEQ ID NO: 30201 - RNA, 1617 nt, Artificial Sequence
  derived and/or modified sequence opt5 from VP1__Norovirus_and/or_Norovirus-like__KX514269
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucaccggcaaaauucaggggaugcuuacacagacgaccaagggagaaggcuccacacgggggcaccgcgccaccgucuacgugggaucugcuaauuacgcccccaagcugggcagaguucaguuugagacagacaccacgaacgaucucgacgcccaucaaaauacaaaauucacccccgugggggucgugcagagcggagaauccccuaagggcagcgagccgcagcaauggguucugcccucuuauuccggccgggauaccccuaacgugcaccuugcucccgccgucgcgccuacauuucccggggaacagcuccuguucuuucgcagcaccaucccuggauguggcgggcaccccaauaugaaccuggacugccugcucccgcaggagugggugcagcauuucuaccaagaggcugccccugcccagucugauguggcucugcuuagauuuguuaaucccgacacaagccggguccuguucgaauguaaacuccacaaguccggauaugugacgguggcccauaccggccagcacgaucuggucauuccucccaacggguacuuuagauucgacucuugggugaaccaguuuuauacacuugcuccgaugggcaauggaaccggccgcaaacgguga

SEQ ID NO: 30202 - RNA, 1617 nt, Artificial Sequence
  derived and/or modified sequence opt5 from VP1__Norovirus_and/or_Norovirus-like__KX514179
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacucccagaucuacaccaugaaucucgcuagcccuaacuggaauaacuaugaccccacagaggagaucccugcgccccugggcaccccggauuucgucggcaaaauucaggggaugcuuacccagacaacgaagggagaaggcuccacccgggggcaccgcgccacaguguacguuggaucugcuaauuacgccccuaagcugggcagagugcaauuugagaccgacacaaccaacgaucucgacgcccaucagaauacgaaauucacacccgucggggugguucagggaggcgaaagccccaagggcuccgagccucaacagugggugcugccgagcuauucugggcgggauacccccaacguccaccuugcuccugccguggcgcccaccuuuccuggagaacagcuccuguucuuucgcuccacaauccccggcugugggggacacccuaauaugaaccuggacugccugcucccccaggagugggugcaacauuucuaccaggaggcugccccggcccagagcgauguugcucugcuuagauuugucaauccugacaccucucgggugcuguucgaauguaaacuccacaagagcggcuaugugacagucgcccauacggggcagcacgaucuggugauucccccuaacggcuacuuuagauucgacuccuggguuaaccaauuuuauacccuugcucccaugggaaauggcacagggcgcaaacgguga

SEQ ID NO: 30203 - RNA, 1617 nt, Artificial Sequence
  derived and/or modified sequence opt5 from VP1__Norovirus_and/or_Norovirus-like__KX514289
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgacacaaccaacgaucucgacgcccaucaaaauacgaaauucacacccgucggggugguucagagcggagaauccccuaagggcagcgagccgcagcaaugggugcugcccucuuauuccggccgggauaccccuaacguccaccuugcucccgccguggcgccuaccuuucccggggaacagcuccuguucuuucgcagcacaaucccuggauguggcgggcaccccaauaugaaccuggacugccugcucccgcaggagugggugcagcauuucuaccaagaggcugccccugcccagucugauguugcucugcuuagauuugucaaucccgacaccagccgggugcuguucgaauguaaacuccacaaguccggauaugugacagucgcccauacgggccagcacgaucuggugauuccucccaacggguacuuuagauucgacucuuggguuaaccaguuuuauacccuugcuccgaugggcaauggaacaggccgcaaacgguga

SEQ ID NO: 30204 - RNA, 1617 nt, Artificial Sequence
  derived and/or modified sequence opt5 from VP1__Norovirus_and/or_Norovirus-like__KX514288
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgacacaaccaacgaucucgacgcccaucaaaauacgaaauucacacccgucggggugguucagagcggagaauccccuaagggcagcgagccgcagcaaugggugcugcccucuuauuccggccgggauaccccuaacguccaccuugcucccgccguggcgccuaccuuucccggggaacagcuccuguucuuucgcagcacaaucccuggauguggcgggcaccccaauauggaccuggauugccugcucccgcaggagugggugcagcauuucuaccaagaggcugccccugcccagucugacguugcucugcuuagauuugucaaccccgauaccagccgggugcuguucgaauguaaacuccacaaguccggauaugugacagucgcccauacgggccagcacgaccuggugauuccucccaauggguacuuuagauucgauucuuggguuaaccaguuuuauacccuugcuccgaugggcaacggaacaggccgcaaacgguga

SEQ ID NO: 30205 - RNA, 1617 nt, Artificial Sequence
  derived and/or modified sequence opt5 from VP1__Norovirus_and/or_Norovirus-like__KX514268
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucacgggaugcuuacccagacaacgaagggagaaggcuccacccgggggcaucgcgccacaguguacguuggaucugcuaauuacgcccccaagcugggcagagugcaguuugagaccgacacaaccaacgaucucgacgcccaccagaauacgaaauucacacccgucggggugguucaaggaggcgaaagcccuaagggcuccgagccgcagcagugggugcugcccagcuauucugggcgggauaccccuaacguccaccuugcucccgccguggcgccuaccuuucccggagaacaacuccuguucuuucgcuccacaaucccuggcugugggggacaucccaauaugaaccuggacugccugcucccgcaggagugggugcagcacuucuaccaggaggcugccccugcccaaagcgauguugcucugcuuagauuugucaaucccgacaccucucgggugcuguucgaauguaaacuccauaagagcggcuaugugacagucgcccacacggggcagcacgaucuggugauuccucccaacggcuacuuuagauucgacuccuggguuaaccaguuuuauacccuugcuccgaugggaaauggcacagggcgcaaacgguga

SEQ ID NO: 30206 - RNA, 1617 nt, Artificial Sequence
  derived and/or modified sequence opt5 from VP1__Norovirus_and/or_Norovirus-like__JX459653
augaagauggccagcuccgaccccaacccuucugauggcagcaccgcuaaucuggugccggaggucaacaaugaaguuauggcccucgagcccguggugggggcggcuaucgccgccccugucgcuggacagcaaaacgugauugaccccuggaucagaaauaacuucguucaggccccuggcggggaauuuacagugucuccccggaaugcuccuggagagauucugugguccgccccgcuuggccccgaucugaacccuuaccucagccaccuggcgcgcauguauaauggguacgccggaggcuucgaaguccaggugauccuugcuggcaacgccuuuacggcugggaaaauuaucuucgccgcgguucccccuaauuuucccaccgagggacuguccccgucucaggugacaauguucccucauaucauugucgacgugagacaacucgagcccgugcugaucccucugcccgauguccggaacaauuuuuaucacuacaaccagagcaaugacuccaagcucaaacugcgccccaugcuuuauaccccucugagagccaacaacgcuggcgaugacguuuucacagugagcugccgggugcucacccgcccgucucccgauuuugacuucauuuuucuggucccucccacaguggaauccagaaccaagccuuucagcguucccgugcuuacggucgaggaaaugaccaauucucgguuuccgaucccucuggagaaacucuucacagggcccuccagcgccuucgugguucagccucagaacggacgcuguaccacagauggcgugcugcuggggaccacgcaacucucucccgucaauauuugcacauuuagaggagacgugacccauaucccuggcucccggaacuacacaaugaaucuggcuagccagaacuggaacuccuaugaucccaccgaggaaauuccggccccucuuggcacccccgacuucgucgggaagauccagggagugcugacacagacgacccgcacaaauggcucuaccagagggcacaaggccacaguuuacaccggaagcgcugacuuuucccccaaacucggccgggugcaauucgcgacggauacagacaaugauuuugagaccaaccagaauaccaaguucacaccugucggggugauccaggacggaagcaccacaccgcgcaacgaaccccaacaguggguucugccuucuuacuccggcagaaauauucauaacgugcaccuugcccccgcugucgccccuacguuucccggcgagcagcuccuguucuuucggagcaccaugccuggguguucuggauaucccaauauggaucuggacugccugcucccgcaggaaugggugcaauacuucuaucaggaggccgcuccugcccagagcgauguggcgcugcuuagauuuguuaaccccgacacaggccgcguccuguucgaguguaaacuccacaaguccggguacgugaccguggcucauacaggacagcacgaucuggucaucccucccaacggcuauuuucgguucgacucuugggugaaucaauucuacacccuugccccgauggggaacggcacgggaagacgccgguga

SEQ ID NO: 30207 - RNA, 1617 nt, Artificial Sequence
  derived and/or modified sequence opt5 from VP1__Norovirus_and/or_Norovirus-like__KX514359
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgacacaaccaacgaucucgacgcccaucaaaauacgaaauucacacccgucggggugguucagggaggcgaaagcccucagcgguccgagccgcaacagugggugcugcccagcuauucuggccgcgauaccccuaacguccaccuugcucccgccguggcgccuaccuuucccggggaacagcuccuguucuuuagauccacaaucccuggauguggcgggcaccccaauaugaaccuggacugccugcucccgcaggagugggugcaacauuucuaccaggaggcugccccugcccagagcgauguugcucugcuucgguuugucaaucccgacaccucuagagugcuguucgaauguaagcuccacaaaagcggauaugugacagucgcccauacgggccagcacgaucuggugauuccucccaacggguacuuucgcuucgacuccuggguuaaccaauuuuauacccuugcuccgaugggcaauggaacaggccggaagagauga

SEQ ID NO: 30208 - RNA, 1617 nt, Artificial Sequence
  derived and/or modified sequence opt5 from VP1__Norovirus_and/or_Norovirus-like__KX514296
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgggacaaccaacgaccucgaugcccaucaaaauacgaaauucacacccgucggagugguucagggcggcgaaagcccucagggguccgagccgcaacagugggugcugcccagcuauucuggacgggacaccccuaacguccaccuugcucccgccguggcgccuaccuuucccggcgaacagcuccuguucuuucgcuccacaaucccuggguguggaggccaccccaauaugaaccuggauugccugcucccgcaggagugggugcaacauuucuaccaggaggcugccccugcccagagcgacguugcucugcuuagauuugucaaucccgauaccucucgggugcuguucgaauguaagcuccacaaaagcggguaugugacagucgcccauacgggccagcacgaccuggugauuccucccaacggauacuuuagauucgauuccuggguuaaccaauuuuauacccuugcuccgaugggcaaugggacaggacgcaagcgguga

SEQ ID NO: 30209 - RNA, 1617 nt, Artificial Sequence
  derived and/or modified sequence opt5 from VP1__Norovirus_and/or_Norovirus-like__KX514284
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgacacaaccaacgaucucgacgcccaucaaaauacgaaauucacacccgucggggugguucagggaggcgaaagcccucagcgguccgagccgcaacagugggugcugcccagcuauucuggccgcgauaccccuaacguccaccuugcucccgccguggcgccuaccuuucccggggaacagcuccuguucuuuagauccacaaucccuggauguggcgggcaccccaauauggaccuggauugccugcucccgcaggagugggugcaacauuucuaccaggaggcugccccugcccagagcgacguugcucugcuucgguuugucaaccccgauaccucuagagugcuguucgaauguaagcuccacaaaagcggauaugugacagucgcccauacgggccagcacgaccuggugauuccucccaauggguacuuucgcuucgauuccuggguuaaccaauuuuauacccuugcuccgaugggcaacggaacaggccggaagagauga

SEQ ID NO: 30210 - RNA, 1617 nt, Artificial Sequence
  derived and/or modified sequence opt5 from VP1__Norovirus_and/or_Norovirus-like__KX514245
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgacacaaccaacgaucucgacgcccaucaaaauacgaaauucacacccgucggggugguucagggaggcgaaagcccucagcgguccgagccgcaacagugggugcugcccagcuauucuggccgcgauaccccuaacguccaccuugcucccgccguggcgccuaccuuucccggggaacagcuccuguucuuuagauccacaaucccuggauguggcgggcaccccaauaugaaccuggacugccugcucccgcaggagugggugcaacauuucuaccaggaggcugccccugcccagagcgauguugcucugcuucgguuugucaaucccgacaccucuagagugcuguucgaauguaagcuccacaaaagcggauaugugacagucacgcauaccggccagcacgaucuggugauuccucccaacggguacuuucgcuucgacuccuggguuaaccaauuuuauacacuugccccgaugggcaauggaaccggccggaagagauga

SEQ ID NO: 30211 - RNA, 1617 nt, Artificial Sequence
  derived and/or modified sequence opt5 from VP1__Norovirus_and/or_Norovirus-like__KX514327
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaacgcuggcgaugacguuuucaccgugagcugcagagugcugacccggcccucuccugauuuugacuucauuuuucucgucccgcccacgguggaaucccgcagcaaaccuuucucuguucccgugcugaccgucgaggaaaugacaaacuccagauuuccugccacccuugauaagcuguucacagggcccagcucuaccuucgugguucagccgcagaauggacgguguaugaucgacggcgugcuccuggggacgacacaacuguccccugucaacauuugcaccuuucgcggagaugugacacauagcggcaauuccaaaaucuacaccaugaaccucgccucucccaauuggaacaauuaugacccuaccgaggagauccccgcuccucugggcacacccgacuucgucgggaagauucagggaaugcuuacgcagaccacaaagggcgaagggagcaccagaggacaccgggcgacaguguacguuggcuccgccaacuacgcuccgaaacuggggcgcgugcaguuugagaccgauacgacagacgaucucgacgcccaucaaaauaccaaguucaccccugucggagugguucagggcggcgaaagccccaaagggucugagccccagcaaugggugcugccuuccuauagcggaagagauacaccgaacguccaccuugcccccgcuguggccccuaccuuucccggcgaacagcuccuguucuuucggucuacaaucccuggguguggaggccaccccaauaugaaccuggacugccugcucccucaggagugggugcagcauuucuaccaagaggcggcucccgcccagagcgauguugcccugcuucgcuuugucaauccggacacguccagagugcuguucgaauguaagcuccacaaaucuggguaugugaccgucgcucauacaggccagcacgaucuggugauuccucccaacggauacuuucgguucgacagcuggguuaaucaguuuuauacccuugccccuaugggcaacgggacaggaagaaagcgcuga

SEQ ID NO: 30212 - RNA, 1617 nt, Artificial Sequence
  derived and/or modified sequence opt5 from VP1__Norovirus_and/or_Norovirus-like__KX514301
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgacacaaccaacgaucucgacgcccaucaaaauacgaaauucacacccgucggggugguucagggaggcgaaagcccuaagggcuccgagccgcagcaaugggugcugcccagcuauucugggcgggauaccccuaacguccaccuugcucccgccguggcgccuaccuuucccggagaacagcuccuguucuuucgcuccacaaucccuggcugugggggacaccccaauaugaaccuggacugccugcucccgcaggagugggugcagcauuucuaccaagaggcugccccugcccagagcgauguugcucugcuuagauuugucaaucccgacaccucucgggugcuguucgaauguaaacuccacaagagcggcuaugugacagucgcccauacggggcagcacgaucuggugauuccucccaacggcuacuuuagauucgacuccuggguuaaccaguuuuauacccuugcuccgaugggaaauggcacagggcgcaaacgguga

SEQ ID NO: 30213 - RNA, 1617 nt, Artificial Sequence
  derived and/or modified sequence opt5 from VP1__Norovirus_and/or_Norovirus-like__KX514299
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucaggggaugcuuacccagacaacgaagggagaaggcuccacccgggggcaccgcgccacaguguacguuggaucugcuaauuacgcccccaagcugggcagagugcaguuugagaccgacacaaccaacgaucucgacgcccaucaaaauacgaaauucacacccgucggggugguucagggaggcgaaagcccucagggcuccgagccgcaacagugggugcugcccagcuauucugggcgggauaccccuaacguccaccuugcucccgccguggcgccuaccuuucccggagaacagcuccuguucuuucgcuccacaaucccuggcugugggggacaccccaauaugaaccuggacugccugcucccgcaggagugggugcaacauuucuaccaggaggcugccccugcccagagcgauguugcucugcuuagauuugucaaucccgacaccucucgggugcuguucgaauguaagcuccacaaaagcggcuaugugacagucgcccauacggggcagcacgaucuggugauuccucccaacggcuacuuuagauucgacuccuggguuaaccaauuuuauacccuugcuccgaugggaaauggcacagggcgcaagcgguga

SEQ ID NO: 30214 - RNA, 1617 nt, Artificial Sequence
  derived and/or modified sequence opt5 from VP1__Norovirus_and/or_Norovirus-like__KX514277
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaacugaaucccuaccucucucaccuggcucgcauguauaacggguacgccggaggcuucgagguccaggugauccuugcuggcaaugccuuuacagcggggaaaauuaucuucgccgcuguuccucccaacuuuccuacggagggacugagccccucccaggugaccauguucccgcauaucauugucgaugugagacaacucgaaccugugcugaucccccugccugacguccggaauaacuuuuaucacuacaaucagucuaacgauagcacaauuaagcucaucgccaugcuguauacaccccuucgcgcuaacaaugccggcgacgauguuuucaccguguccugcagagugcugacccggcccagcccugacuuugauuucauuuuucucgucccgcccacaguggagucucgcuccaaaccuuucagcguucccgugcugaccgucgaagagaugacgaacucuagauuuccugccacccuugacaagcuguucacagggcccuccagcaccuucgugguucagccgcagaauggacgguguaugaucgauggcgugcuccuggggacaacccaacugucuccugucaacauuugcacguuucgcggagacgugacacaucccagagauuccccuaucuacaccaugaaucucgcuagccccaacuggaauaacuaugacccuacagaggaaauccccgcgccgcugggcaccccugacuucgucggcaaaauucaggggaugcuuacccagacaacgaagggagagggcuccacccgggggcaccgcgccacaguguacguuggaucugcuaauuacgcccccaagcugggcagagugcaguuugaaaccgauacaaccaacgaccucgaugcccaucaaaauacgaaauucacacccgucggggugguucagggaggcgagagcccuaagggcuccgaaccgcagcaaugggugcugcccagcuauucugggcgggacaccccuaacguccaccuugcucccgccguggcgccuaccuuucccggagagcagcuccuguucuuucgcuccacaaucccuggcugugggggacaccccaauaugaaccuggauugccugcucccgcaggagugggugcagcauuucuaccaagaagcugccccugcccagagcgacguugcucugcuuagauuugucaaucccgauaccucucgggugcuguucgaguguaaacuccacaagagcggcuaugugacagucgcccauacggggcagcacgaccuggugauuccucccaacggcuacuuuagauucgauuccuggguuaaccaguuuuauacccuugcuccgaugggaaauggcacagggcgcaaacgguga

SEQ ID NO: 30215 - RNA, 1617 nt, Artificial Sequence
  derived and/or modified sequence opt5 from VP1__Norovirus_and/or_Norovirus-like__KX514213
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccguccaggagaugacgaacucuagauuuccugccacccuugauaagcuguucacagggcccuccagcaaucucgugguucagccgcaaaacggacgguguaugaucgacggcgugcugcuggggaccacacagcucucuccugucaauauuugcaccuuccgcggagaugugacgcaucccagagacuccccuaucuacacaaugaaccuggcuagccccaauuggaacaauuaugacccuaccgaagagauccccgcgccgcuuggcacaccugauuuugucggcaaaauucaggggaugcugacccagaccacaaagggagagggcuccacgcgggggcaccgcgccaccguguacguuggaucugcuaacuacgcccccaagcucggcagagugcaauucgaaacagacaccacaaaugaucuggacgcccaucagaacaccaaauuuacgcccgucggggugguucagggaggcgagagcccucaacgguccgaaccgcagcagugggugcuucccagcuauucuggccgcgauacaccuaauguccaccuggcucccgccguggcgccuaccuuccccggggagcagcuccuguuuuucagauccaccaucccuggauguggcgggcaccccaacaugaaucuggacugccuccugccgcaagaaugggugcagcauuuuuaccaggaggcugccccugcccagagcgauguugcccuucugcgguucgucaaccccgacacaucuagagugcucuuugaguguaagcugcacaaaagcggauaugugaccgucgcucauacaggccaacacgaucuugugauuccucccaacggguacuuccgcuuugacuccuggguuaaucaguucuauacgcuggcuccgaugggcaacggaaccggccggaagagauga

SEQ ID NO: 30216 - RNA, 1617 nt, Artificial Sequence
  derived and/or modified sequence opt5 from VP1__Norovirus_and/or_Norovirus-like__KT033903
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcggggauguuuucaccgugagcugcagagugcugacacggcccucuccugacuuugauuucauuuuucucgucccgcccaccguggaaucccgcacgaaaccuuucagcguucccgugcugaccgucgaggaaaugacaaauucuagauuuccuaucccccuugagaagcuguucaccggaccguccagcgccuucgugguucagccucagaacggccgguguacaaccgacggggugcuccugggaacgacacaacugucucccgucaauauuugcaccuuucgcggcgaugugacacauaucccuggcuccagaaacuacaccaugaaucucgccagccagaacuggaacuccuaugaccccaccgaggaaaucccugcuccccuggggacaccggauuucgucggaaaagugcagggcguucuuacgcagaccacacggaccaaugggucuacacgcggacacaaggcgaccguguacacgggcagcgccgacuuuuccccuaagcuggggagaguccaauucgcuacagacaccgauaaugacuuugagaccaaccagaauacaaaauucacccccgugggaguuauucaggauggcagcacaacgccccggaacgaaccucaacagugggugcucccgucuuacuccggccgcaauauccauaacguccaccuggcccccgccguggcuccuaccuuucccggggagcagcuucuguucuuuagaagcacaaugccuggauguucuggcuaucccaauauggaccucgauugccugcugccucaggaaugggugcaauacuucuaucaggaggccgcgcccgcucagagcgacguugcccuccugcgguuugucaacccggauaccgugagagugcuuuucgaguguaagcugcacaaauccggguacgucacaguggcccauaccggacagcacgaccucguuauuccucccaacggcuauuuucgcuucgauucuugggugaaucaauucuacacgcuggcuccuauggggaacggcaccggacggagacgcuga

SEQ ID NO: 30217 - RNA, 1617 nt, Artificial Sequence
  derived and/or modified sequence opt5 from VP1__Norovirus_and/or_Norovirus-like__HM625866
augaagauggccagcuccgacgcuaaccccucugauggcagcaccgccaaucuggugccugaggucaacaaugaaguuauggcgcucgagccgguggugggggcugccuccgccgcucccgucgccggacagcaaaacgugaucgacccuuggauuagaaauaacuucguucaggcucccggcggggaauuuacagagucuccuacgaaugcccccggagaaauccuguggagcgcgccucuuggcccggaucugaaccccuaccucucccaccuggcccggauguauaauggguacgcuggaggcuucgaggugcaggucauucuugccggcaacgcuuuuaccgccgggaaaaucauuuucgcggccgugccucccaauuuuccuacagagggacugucucccagccagguuaccauguucccgcauaucaucguggacguccgccaacucgaaccugugcugauuccccugccugaugugagaaacaauuuuuaucacuacaaccaguccaaugaccccacaaucaagcucauugcuaugcuguauacaccccuucgggccaacaacgcuggcgaugacgucuucaccguuagcugccgcgugcugaccagaccuucuccggauuuugacuucaucuuucucgugcccgccacggucgagucccggaccaaaccuuucagcgugcccguucugacaguggaagagaugaccaauucucgcuuuccuauuccccuugagaagcuguucacagggccguccagcgccuucgucgugcagccucagaacggaagauguaccacggauggcguucuccuggggacaacccaacugucucccgugaauaucugcacauuucggggagacgucacccauauuccuggcucccgcaacuacaccaugaaucucgcuagccagaacuggaacuccuaugaucccacagaagagaucccugcgcccgugggcacgccggacuucgucgggaaaauccagggagugcugacccagacaaccagaacaaauggcucuacccgggggcacaaggccacgguuuacacaggaagcgcugacuuuuccccuaaacuuggccgcgugcaauucgccaccgauaccgacaaugauuuugaaacaaaccagaauaccaaguucacacccgucggggugauucaggacggaagcacgacccccagaaacgagccucaacaguggguucugccgucuuacuccggccggaauauccauaacgugcaccucgcccccgcugucgccccuacauuucccggcgaacagcugcuuuucuuucgcagcaccaugccuggguguucuggauaucccaauauggaucuggacugccuccugccucaggagugggugcaauacuucuaucaggaggcggcucccgcccagagcgauguggcccugcucagauuuguuaacccggacacaggccggguccuguucgaauguaaacuucacaaguccggguacgugaccguggcucauacgggacagcacgaucuggucauuccucccaacggcuauuuuagauucgacucuugggugaaucaauucuacacccucgccccuauggggaacggcacaggacgccggagauga

SEQ ID NO: 30218 - RNA, 1617 nt, Artificial Sequence
  derived and/or modified sequence opt5 from VP1__Norovirus_and/or_Norovirus-like__KX514319
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaacgcuggcgaugacguuuucaccgugagcugcagagugcugacccggcccucuccugauuuugacuucauuuuucucgucccgcccacgguggaaucccgcagcaaaccuuucucuguucccgugcugaccgucgaggaaaugacaaacuccagauuuccugccacccuugauaagcuguucacagggcccagcucuaccuucgugguucagccgcagaauggacgguguaugaucgacggcgugcuccuggggacgacacaacuguccccugucaacauuugcaccuuucgcggagaugugacacaucccggcggcagcaaaaucuacaccaugaaucucgccuccccuaacuggaauaacuaugaccccaccgaggagaucccugcuccccuggggacaccggacuucgucggaaagauucagggcaugcuuacgcagaccacaaagggggaaggaucuaccagaggccaccgggcgacaguguacguugggagcgccaauuacgcuccuaaacugggacgcgugcaguuugagaccgauacgacagacgaucucgacgcccaucaaaacaccaaguucacccccgucggcgugguucagggcggggaaucccccaaaggaagcgagccucagcaaugggugcugccgucuuauuccggcagagauacacccaauguccaccuugccccugcuguggcccccaccuuuccuggggaacagcuccuguucuuucggagcacaauccccggauguggcgggcacccuaacauggaccuggauugccugcucccccaggagugggugcagcauuucuaccaagaggcggcuccggcccagucugacguugcccugcuucgcuuugucaauccugauacgagcagagugcuguucgaauguaagcuccacaaauccggcuaugugaccgucgcucauacaggacagcacgaccuggugauucccccuaacggcuacuuucgguucgauucuuggguuaaucaguuuuauacccuugcccccauggggaacggaacaggcagacgccgguga

SEQ ID NO: 30219 - RNA, 1617 nt, Artificial Sequence
  derived and/or modified sequence opt5 from VP1__Norovirus_and/or_Norovirus-like__KX514311
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaauucuagauuucccauuaaccuugaacggcuguucaccggaccguccagcgcuaaugucgugcagccucagaacggccgcuguaugaucgaugggguucuccugggaacaacccaacugucucccgugaauaucugcacguucagaggcgacgucacacauccuggcggguccaagauuuacaccaugaaccucgccagccccaauuggaacaauuaugauccuacagaggagauccccgccccgcugggaaccccugacuuugugggcaaaauucaggggaugcuuacccagacaacgaagggagaaggcuccacccgggggcaccgcgcuacagucuacgugggaucugcgaacuacgcccccaagcugggcagaguucaguucgagaccgacacaaccgaugaccucgaugcucaucaaaauacgaaauuuacacccgugggcgucgugcaagggggagaaagcccuaagggcuccgagccgcagcaguggguucugcccagcuauucugggcgggacaccccuaacgugcaccuugcccccgccgucgcuccuaccuuccccggagaacagcugcucuuuuuccgcuccacaaucccuggcugugggggccaccccaauaugaaccuggauugccugcucccgcaggagugggugcagcauuuuuaccaagaggccgcgccugcucagagcgacguggcccugcuuagauucguuaaucccgauaccucucggguccuguuugaauguaaacuccacaagagcggauaugugacaguggcccauacgggccagcacgaccuggucauuccucccaacggguacuucagauuugauuccugggugaaccaguucuauacccuugcuccgaugggaaauggcacagggcgcaaacgguga

SEQ ID NO: 30220 - RNA, 1617 nt, Artificial Sequence
  derived and/or modified sequence opt5 from VP1__Norovirus_and/or_Norovirus-like__KX514266
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccggcgacuccccuaucuacaccaugaaucucgcuagccccaacuggaauaacuaugacccuacagaggagauccccgcgccgcugggcaccccugauuucgucgggaaaauucagggaaugcuuacccagacaacgaagggcgaaggguccaccagaggacaccgggccacaguguacguuggcucugcuaauuacgcccccaagcuggggcgcgugcaguuugagaccgacacaaccaacgaucucgacgcccaucaaaauacgaaauucacacccgucggagugguucagggcggcgaaagcccuaagggguccgagccgcagcaaugggugcugcccagcuauucuggaagagauaccccuaacguccaccuugcucccgccguggcgccuaccuuucccggcgaacagcuccuguucuuucgguccacaaucccuggguguggaggccaccccaauaugaaccuggacugccugcucccgcaggagugggugcagcauuucuaccaagaggcugccccugcccagagcgauguugcucugcuucgcuuugucaaucccgacaccucuagagugcuguucgaauguaaacuccacaagagcggguaugugacagucgcccauacgggccagcacgaucuggugauuccucccaacggauacuuucgguucgacuccuggguuaaccaguuuuauacccuugcuccgaugggcaaugggacaggaagaaaacgcuga

SEQ ID NO: 30221 - RNA, 1617 nt, Artificial Sequence
  derived and/or modified sequence opt5 from VP1__Norovirus_and/or_Norovirus-like__KX514235
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuagcgacuccacaauuaagcucaucgccaugcuguauacgccccuucgcgcuaacaacgccggcgaugacguuuucacagugagcugcagagugcugacccggcccucuccugauuuugacuucauuuuucucgucccgcccacaguggaaucccgcagcaaaccuuucucuguucccgugcugaccgucgaggaaaugaccaauuccagauuuccugccacccuugauaagcuguucacagggcccagcucuaccuucgugguucagccgcagaacggacgguguaugaucgacggcgugcuccuggggacaacccaacuguccccugucaauauuugcacguuucgcggagaugugacacaucccagagacagcccuaucuacaccaugaaccucgcuucccccaauuggaacaauuaugacccuacagaggagauccccgcgccgcugggcaccccugauuucgucggcaaaauucaggggaugcuuacccagacaacgaagggagaaggcucuacccgggggcaccgcgccacaguguacguuggaagcgcuaacuacgcccccaagcugggcagagugcaguuugagaccgacacaaccaaugaucucgacgcccaucaaaacacgaaauucacacccgucggggugguucagggaggcgaauccccucagcggagcgagccgcaacagugggugcugcccucuuauuccggccgcgauaccccuaauguccaccuugcucccgccguggcgccuaccuuucccggggaacagcuccuguucuuuagaagcacaaucccuggauguggcgggcaccccaacaugaaucuggacugccugcucccgcaggagugggugcaacauuucuaccaggaggcugccccugcccagucugauguugcucugcuucgguuugucaaccccgacaccagcagagugcuguucgaauguaagcuccacaaauccggauaugugacagucgcccauacgggccagcacgaucuggugauuccucccaauggguacuuucgcuucgacucuuggguuaaccaauuuuauacccuugcuccgaugggcaacggaacaggccggaagagauga

SEQ ID NO: 30222 - RNA, 1617 nt, Artificial Sequence
  derived and/or modified sequence opt5 from VP1__Norovirus_and/or_Norovirus-like__KX354115
augaagauggccagcuccgacgcuaaccccucugauggcagcgccgcgaaucuggugccugaggcuaacaaugaagucauggcccucgagccgguugccggggcugcccuggcugcccccguggcgggacagcaaaacgugaucgacccuuggauuagaaauaacuucguccaggcccccggcggggaauuuaccaucuccccucggaaugcucccggagagauucuuuggucugccccucugggcccggaucucaaccccuaccugagccaccuugcucgcauguauaauggguacgccggaggcuucgaagugcagguuauccuggcgggcaacgccuuuacagcugggaaagugauuuucgccgcugucccucccaauuuuccuacguccggacucucucccagccaggugaccauguucccguccguuguggucgacgugagacaacuggagccugugcugaucccccucccugauguccggaacaauuuuuaucauuacaaccagagcaaugaccccacaaucacccugauugccaugcuuuauacaccccugcgcgccaacaacgcuggcgaugacguuuucaccgugucuugcagagugcucacacggccuuccccggauuuugacuucaucuuucuggugcccccuaccgucgagagccgcacgaagcccuucucuguuccugugcuuaccgucgaagagaugacaaauuccagauuucccauuccgcuggaacggcuguucaccgggccuagcucugcguucgugguucagccccagaacggacgcuguacaaccgauggcgugcugcuggggacgacacaacucuccccugucaauaucugcaccuuuagaggagacauuauccacauuacaggcagccauaacuacaccaugaaucuggccucccagaacuggaauaacuaugaucccaccgaggagaucccugcuccccuuggcacaccggacuucguggggaaaauccagggaguccugacgcagaccacacggggcgacgggucuacccgcggacacaaggccacaguguacaccggcagcgccgauuuuauuccuaaacucgggagaguucaauucgaaacggacacaaaucaugauuuugaggcuaaccagaauaccaaguucacccccgugggagucauccaggacggcuccacaacccaccggaacgaaccccaacagugggugcugccuagcuacucuggccgcaauacacacaacguucaucuugccccggcgguggcucccacguuuccuggggagcagcuccucuucuuuagauccaccaugcccggauguagcggcuauccuaauauggaucuggacugccugcucccccaggaauggguccaauacuucuaucaggaggccgccccugcucagucugauguggcccugcuucgguuugugaaccccgacacagggagaguucuguucgaguguaagcuccacaaaagcggauacauuaccgucgcucauacaggccagcacgaucuggugaucccgccuaacggguauuuucgcuucgacuccugggugaaucaauucuacacccuugcccccaugggcaacggaacgggccggagacgcuga

SEQ ID NO: 30223 - RNA, 1617 nt, Artificial Sequence
  derived and/or modified sequence opt5 from VP1__Norovirus_and/or_Norovirus-like__KM272334
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcacauauaauggguacgccggaggcuucgaaguccaggugauccuugcuggcaacgccuuuacggcggggaaaguuauuuucgccgcugugccucccaauuuuccuaccgagggacugucccccucucaggucacaauguucccgcauaucgugguggacgccagacaacucgagccuguccugaucccccugccugauguucggaacaauuuuuaucacuacaaccagagcaaugaccccaccauuaagcucaucgcuaugcuguauacaccccuucgcgccaacaacgccggcgaugacguguucaccguguccugcagaguccugacacggccuagcccggauuuugacuucauuuuucucgugcccccuaccguugaaucucgcacgaaacccuucuccgugccuguccugaccguggaggaaaugacaaauagcagauuucccaucccgcuugagaagcuguucaccgggccuucuuccgcuuucguugugcagccccagaacagccgguguacaaccgauggaguccuccugggcacgacacaacugucuccugugaauauuugcaccuuucgcggggacgucacacauaucaccggauccagaaacuacaccaugaaucucgcgagccagaacuggaauaacuaugaucccacagaggaaauuccugugccccugggcacgccggacuucguuggcaaaauccagggggugcuuacccagacaacccggacagacggauccacccgcggccacaaggccacggucuacacagggucugcugauuuugccccuaagcugggaagagugcaauucgagaccgacaccgaucaugacuuugaagccaaucagaacacaaaauucacccccguuggcgugauccaggaugggggaacaacgcaccggaaugagccccaacaguggguccucccuagcuacuccggccgcaacacccacaaugugcaucuggcuccggccguggcgcccacauuuccuggcgaacagcuucuguucuuuagaagcaccaugcccggguguucuggauauccuaacauggaccucgauugccugcugccccaggaguggguucaauacuucuaucagggcgcugccccugcccaguccgacgucgcucuccugcgguuugugaaucccgauacagggagagugcuuuucgaguguaagcugcacaaaagcggauacgucaccguggcccauacgggccagcacgaccucguuauuccgccuaacggguauuuucgcuucgauucuugggugaaccaauucuacacccuggcucccaugggcaauggaacaggccggagacgcuga

SEQ ID NO: 30224 - RNA, 1617 nt, Artificial Sequence
  derived and/or modified sequence opt5 from VP1__Norovirus_and/or_Norovirus-like__KX354116
augaagauggccagcuccgacgcuaaccccucugauggcagcgccgcgaaucuggugccugaggcuaacaaugaagucauggcccucgagccgguugccggggcugcccuggcugcccccguggcgggacagcaaaacgugaucgacccuuggauuagaaauaacuucguccaggcccccggcggggaauuuaccaucuccccucggaaugcucccggagagauucuuuggucugccccucugggcccggaucucaaccccuaccugagccaccuugcucgcauguauaauggguacgccggaggcuucgaagugcagguuauccuggcgggcaacgccuuuacagcugggaaagugauuuucgccgcugucccucccaauuuuccuacggccggacucucccccucucaggugaccauguucccgagcguuguggucgacgugagacaacuggagccugugcugaucccccucccugauguccggaacaauuuuuaucauuacaaccaguccaaugaccccacaaucacccugauugccaugcuuuauacaccccugcgcgcuaacaacgcgggcgaugacguuuucaccgugagcugcagagugcucacacggccuucuccggauuuugacuucaucuuucuggugcccccuaccgucgagucccgcacgaagcccuucagcguuccugugcuuaccgucgaagagaugacaaauucuagauuucccauuccgcuggaacggcuguucaccgggccuuccagcgccuucgugguucagccccagaacggacgcuguacaaccgauggcgugcugcuggggacgacacaacucucuccugucaauaucugcaccuuuagaggagacauuauccacauuacaggcucccauaacuacaccaugaaucuggcuagccagaacuggaauaacuaugaucccaccgaggagaucccugcuccccuuggcacaccggacuucguggggaaaauccagggaguccugacgcagaccacacggggcgacggguccacccgcggacacaaggccacaguguacaccggcucugccgauuuuauuccuaaacucgggagaguucaauucgaaacggacacaaaucaugauuuugaggccaaccagaauaccaaguucacccccgugggagucauccaggacggcagcacaacccaccggaacgaaccccaacagugggugcugccuuccuacagcggccgcaauacacacaacguucaucuugcgccggcuguggcccccacguuuccuggggagcagcuccucuucuuuagaucuaccaugcccggauguuccggcuauccuaauauggaucuggacugccugcucccccaggaauggguccaauacuucuaucaggaggccgcuccugcccagagcgauguggcucugcuucgguuugugaaccccgacacagggagaguucuguucgaguguaagcuccacaaaucuggauacauuaccgucgcccauacaggccagcacgaucuggugaucccgccuaacggguauuuucgcuucgacagcugggugaaucaauucuacacccuugcgcccaugggcaacggaacgggccggagacgcuga

SEQ ID NO: 30225 - RNA, 1617 nt, Artificial Sequence
  derived and/or modified sequence opt5 from VP1__Norovirus_and/or_Norovirus-like__KX514172
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaacgccggcgaugacguuuucaccgugagcugcagagugcugacacggcccucuccugauuuugacuucauuuuucucgucccgcccaccguggaaucccgcagcaaaccuuucucuguucccgugcugacggucgaggaaaugaccaacuccagauuuccugccacacuugauaagcuguucaccgggcccagcucuacauucgugguucagccgcagaauggacgguguaugaucgacggcgugcuccuggggaccacgcaacuguccccugucaacauuugcacauuucgcggagaugugacccaucccagagacagccagaucuacacaaugaaucucgcuuccccuaacuggaauaacuaugaccccaccgaggagaucccugcgccccugggcaccccggauuucgucggcaaaauucaggggaugcuuacacagacgaccaagggagaaggcucuacacgggggcaccgcgccaccguguacguuggaagcgcuaauuacgccccuaagcugggcagagugcaauuugagacagacaccacgaacgaucucgacgcccaucagaauacaaaauucacccccgucggggugguucagggaggcgaaucccccaagggcagcgagccucaacagugggugcugccgucuuauuccgggcgggauacccccaacguccaccuugcuccugccguggcgcccacauuuccuggagaacagcuccuguucuuucgcagcaccauccccggcugugggggacacccuaauaugaaccuggacugccugcucccccaggagugggugcaacauuucuaccaggaggcugccccggcccagucugauguugcucugcuuagauuugucaauccugacacaagccgggugcuguucgaauguaaacuccacaaguccggcuaugugacggucgcccauaccgggcagcacgaucuggugauucccccuaacggcuacuuuagauucgacucuuggguuaaucaauuuuauacacuugcucccaugggaaacggcaccgggcgcaaacgguga

SEQ ID NO: 30226 - RNA, 1617 nt, Artificial Sequence
  derived and/or modified sequence opt5 from VP1__Norovirus_and/or_Norovirus-like__KX354114
augaagauggccagcuccgacgcuaaccccucugauggcagcgccgcgaaucuggugccugaggcuaacaaugaagucauggcccucgagccgguugccggggcugcccuggcugcccccguggcgggacagcaaaacgugaucgacccuuggauuagaaauaacuucguccaggcccccggcggggaauuuaccaucuccccucggaaugcucccggagagauucuuuggucugccccucugggcccggaucucaaccccuaccugagccaccuugcucgcauguauaauggguacgccggaggcuucgaagugcagguuauccuggcgggcaacgccuuuacagcugggaaagugauuuucgccgcugucccucccaauuuuccuacguccggacucucucccagccaggugaccauguucccguccguuguggucgacgugagacaacuggagccugugcugaucccccucccugauguccggaacaauuuuuaucauuacaaccagagcaaugaccccacaaucacccugauugccaugcuuuauacaccccugcgcgccaacaacgcuggcgaugacguuuucaccgugucuugcagagugcucacacggccuuccccggauuuugacuucaucuuucuggugcccccuaccgucgagagccgcacgaagcccuucucuguuccugugcuuaccgucgaagagaugacaaauuccagauuucccauuccgcuggaacggcuguucaccgggccuagcucugcguucgugguucagccccagaacggacgcuguacaaccgauggcgugcugcuggggacgacacaacucuccccugucaauaucugcaccuuuagaggagacauuauccacauuacaggcagccauaacuacaccaugaaucuggccucccagaacuggaauaacuaugaucccaccgaggagaucccugcuccccuuggcacaccggacuucguggggaaaauccagggaguccugacgcagaccacacggggcgacgggucuacccgcggacacaaggccacaguguacaccggcagcgccgauuuuauuccuaaacucgggagaguucaauucgaaacggacacaaaucaugauuuugaggcuaaccagaauaccaaguucacccccgugggagucauccaggacggcuccacaacccaccggaacgaaccccaacagugggugcugccuagcuacucuggccgcaauacacacaacguucaucuugccccggcgguggcucccacguuuccuggggagcagcuccucuucuuuagauccaccaugcccggauguagcggcuauccuaauauggaucuggacugccugcucccccaggaauggguccaauacuucuaucaggaggccgccccugcucagucugauguggcccugcuucgguuugugaaccccgacacagggagaguucuguucgaguguaagcuccacaaaagcggauacauuaccgucgcucauacaggccagcacgaucuggugaucccgccuaacggguauuuucgcuucgacuccugggugaaucaauucuacacccuugcccccaugggcaacggaacgggccggaagagauga

SEQ ID NO: 30227 - RNA, 1617 nt, Artificial Sequence
  derived and/or modified sequence opt5 from VP1__Norovirus_and/or_Norovirus-like__KX514295
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugaaccccagccaggugacaauguucccgcauaucauugucgacgugagacaacucgagccugugcugaucccccugccugauguccggaauaacuuuuaucacuacaaucaguccaacgacucuaccauuaagcucaucgccaugcuguauacaccccuucgcgcuaacaaugccggcgaugacguuuucaccgugagcugcagagugcugacacggcccuccccugauuuugacuucauuuuucucgucccgcccaccguggaaagccgcucuaaaccuuucuccguucccgugcugacggucgaggaaaugaccaacagcagauuuccugccacacuugauaagcuguucaccgggcccucuuccacauucgugguucagccgcagaauggacgguguaugaucgacggcgugcuccuggggaccacgcaacugagcccugucaacauuugcacauuucgcggagaugugacccaucccagagacucuccuaucuacacaaugaaucucgcuucccccaacuggaauaacuaugacccuaccgaggagauccccgcgccgcugggcaccccugauuucgucggcaaaauucaggggaugcuuacacagacgaccaagggagaaggcagcacacgggggcaccgcgccaccguguacguuggauccgcuaauuacgcccccaagcugggcagagugcaguuugagacagacaccacgaacgaucucgacgcccaucaaaauacaaaauucacccccgucggggugguucagggaggcgaaucuccuaagggcagcgagccgcagcaaugggugcugcccuccuauagcgggcgggauaccccuaacguccaccuugcucccgccguggcgccuacauuucccggagaacagcuccuguucuuucgcucuaccaucccuggcugugggggacaccccaauaugaaccuggacugccugcucccgcaggagugggugcagcauuucuaccaagaggcugccccugcccaguccgauguugcucugcuuagauuugucaaucccgacacaagccgggugcuguucgaauguaaacuccacaagucuggcuaugugacggucgcccauaccgggcagcacgaucuggugauuccucccaacggcuacuuuagauucgacagcuggguuaaccaguuuuauacacuugcuccgaugggaaauggcaccgggcgcaaacgguga

SEQ ID NO: 30228 - RNA, 1617 nt, Artificial Sequence
  derived and/or modified sequence opt5 from VP1__Norovirus_and/or_Norovirus-like__KX514242
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacgccccuucgcgcuaacaacgccggcgaugacguuuucacagugagcugcagagugcugacccggcccucuccugauuuugacuucauuuuucucgucccgcccacaguggaaucccgcagcaaaccuuucucuguucccgugcugaccgucgaggaaaugaccaauuccagauuuccugccacccuugauaagcuguucacagggcccagcucuaccuucgugguucagccgcagaacggacgguguaugaucgacggcgugcuccuggggacaacccaacuguccccugucaauauuugcacguuucgcggagaugugacacaucccagagacagcccuaucuacaccaugaaccucgcuucccccaauuggaacaauuaugacccuacagaggagauccccgcgccgcugggcaccccugauuucgucggcaaaauucaggggaugcuuacccagacaacgaagggagaaggcucuacccgggggcaccgcgccacaguguacguuggaagcgcuaacuacgcccccaagcugggcagagugcaguuugagaccgacacaaccaaugaucucgacgcccaucaaaacacgaaauucacacccgucggggugguucagggaggcgaauccccucagcggagcgagccgcaacagugggugcugcccucuuauuccggccgcgauaccccuaauguccaccuugcucccgccguggcgccuaccuuucccggggaacagcuccuguucuuuagaagcacaaucccuggauguggcgggcaccccaacauggaccuggauugccugcucccgcaggagugggugcaacauuucuaccaggaggcugccccugcccagucugacguugcucugcuucgguuugucaaucccgauaccagcagagugcuguucgaauguaagcuccacaaauccggauaugugacagucgcccauacgggccagcacgaccuggugauuccucccaacggguacuuucgcuucgauucuuggguuaaucaauuuuauacccuugcuccgaugggcaacggaacaggccggaagagauga

SEQ ID NO: 30229 - RNA, 1617 nt, Artificial Sequence
  derived and/or modified sequence opt5 from VP1__Norovirus_and/or_Norovirus-like__KX514224
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaauguuuuuacagccgggaaaauuaucuucgcggccgugccucccaacuuuccuacggagggacugagccccucccaggucaccauguucccgcauaucauuguggacgugagacaacucgagccuguccugaucccccugccugauguucggaauaacuuuuaucacuacaaucagucuaacgacagcacaauuaagcucaucgcuaugcuguauacaccccuucgcgccaacaaugcuggcgaugacguguucaccguguccugcagaguccugacccggcccagcccugauuuugacuucauuuuucucgugccgcccacaguugaaucucgcuccaaaccuuucagcgugcccguccugaccguggaggaaaugacgaacucuagauuuccugccacccuugauaagcuguucacagggcccuccagcaccuucguugugcagccgcagaauggacgguguaugaucgacggcguccuccuggggacaacccaacugucuccugugaacauuugcacguuucgcggagaugucacacaucccagagacuccccuaucuacaccaugaaucucgccagccccaacuggaauaacuaugacccuacagaggagauccccgcuccgcugggcaccccugauuucgugggcaaaauucaggggaugcuuacccagacaacgaagggagaaggcuccacccgggggcaccgcgcgacaguuuacgugggaucugccaauuacgcucccaagcugggcagaguccaguuugagaccgacacaaccaacgaucucgacgcccaucaaaauacgaaauucacacccguggggguugugcagggaggcgaaagcccucagcgguccgagccgcaacaguggguccugcccagcuauucuggccgcgauaccccuaacgugcaccuugcccccgcuguggccccuaccuuucccggggaacagcuccuguucuuuagauccacaaucccuggauguggcgggcaccccaauaugaaccuggacugccugcucccgcaggaguggguucaacauuucuaccaggaggcggcuccugcccagagcgaugucgcccugcuucgguuugugaaucccgacaccucuagagugcuguucgaauguaagcuccacaaaagcggauaugucacaguggcucauacgggccagcacgaucugguuauuccucccaacggguacuuucgcuucgacuccugggugaaccaauuuuauacccuugccccgaugggcaauggaacaggccggaagagauga

SEQ ID NO: 30230 - RNA, 1617 nt, Artificial Sequence
  derived and/or modified sequence opt5 from VP1__Norovirus_and/or_Norovirus-like__KX514262
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaacgccggcgaugacguuuucaccgugagcugcagagugcugacacggcccucuccugauuuugacuucauuuuucucgucccgcccaccguggaaucccgcagcaaaccuuucucuguucccgugcugacggucgaggaaaugaccaacuccagauuuccugccacacuugauaagcuguucaccgggcccagcucugcuuucgugguucagccgcagaauggacgguguaugaucgacggcgugcuccuggggacaacccaacuguccccugucaacauuugcacguuucgcggagaugugacacaucccagagacagcccuaucuacaccaugaaucucgcgucccccaacuggaauaacuaugacccuacagaggagauccccgccccgcugggcaccccugauuucgucggcaaaauucaggggaugcuuacccagacaacgaagggagaaggcucuacccgggggcaccgcgcuacaguguacguuggaagcgccaauuacgcccccaagcugggcagagugcaguuugagaccgacacaaccaacgaucucgacgcucaucaaaauacgaaauucacacccgucggggugguucagggaggcgaauccccuaagggcagcgagccgcagcaaugggugcugcccucuuauuccgggcgggauaccccuaacguccaccuugcccccgcgguggcuccuaccuuucccggagaacagcuccuguucuuucgcagcacaaucccuggcugugggggacaccccaauaugaaccuggacugccugcucccgcaggagugggugcagcauuucuaccaagaggccgccccugcucagucugauguugcccugcuuagauuugucaaucccgacaccagccgggugcuguucgaauguaaacuccacaaguccggcuaugugacagucgcucauacggggcagcacgaucuggugauuccucccaacggcuacuuuagauucgacucuuggguuaaucaguuuuauacccuugccccgaugggaaacggcacagggcgcaaacgguga

SEQ ID NO: 30231 - RNA, 1617 nt, Artificial Sequence
  derived and/or modified sequence opt5 from VP1__Norovirus_and/or_Norovirus-like__KX354139
augaagauggccagcuccgacgcuaaccccucugauggcagcgccgcgaaucuggugccugaggcuaacaaugaagucauggcccucgagccgguugccggggcugcccuggcugcccccguggcgggacagcaaaacgugaucgacccuuggauuagaaauaacuucguccaggcccccggcggggaauuuaccaucuccccucggaaugcucccggagagauucuuuggucugccccucugggcccggaucucaaccccuaccugagccaccuugcucgcauguauaauggguacgccggaggcuucgaagugcagguuauccuggcgggcaacgccuuuacagcugggaaagugauuuucgccgcugucccucccaauuuuccuacgaccggacucucccccucucaggugacaauguucccgagcguuguggucgacgugagacaacuggagccugugaugaucccccugccugauguccggaacaauuuuuaucauuacaaccaguccaaugaccccaccaucacacucauugccaugcuguauacaccccuucgcgccaacaacgcuggcgaugacguuuucaccgugagcugcagagugcugacccggccuucuccggauuuugacuucaucuuucucgugcccccuacggucgagucccgcaccaagcccuucagcguuccugugcugacagucgaagagaugaccaauucuagauuucccauuccgcuugaacggcuguucacagggccuuccagcgcguucgugguucagccccagaacggacgcuguaccacggauggcgugcuccuggggacaacccaacugucuccugucaauaucugcacauuuagaggagacgugacccacauuaccggcucccggaacuacacaaugaaucucgccagccagaacuggaauaacuaugaucccacggaggagaucccugcuccccugggcaccccggacuucgucgggaaaauucagggaaugcuuacacagaccacacgcaccgacggcuccacgagagggcauaaggccacaguguacaccggaucugccgauuuugcuccuaaacugggccggguucaauucgaaaccgacacagaucacgacuuugaggccaaucagaacaccaaguucacacccgugggggucauccaggauggaagcacgacccaucgcaaugaaccccaacagugggugcucccuuccuacagcggcagaaacacacacaauguucaccuggcgccggcuguggcccccaccuuuccuggcgagcaggucaucuucauucggucuacaaugcccggguccagcggauauccuaacauggaccuugauugucugcucccccaggaaugggugcaauacuuuuaucaggaggccgcuccugcccagucugacguggcuaugaucagauucguuaaucccgauaccggccgcguccuguuugagugcaagcugcauaaaagcggguacauuacgguggcccacaccggacagcaugaccucgugaucccgccuaacggcuauuuccgguuugauuccugggucaaccaauucuacacacuggcgcccauggggaauggcaccggaagacgccgguga

SEQ ID NO: 30232 - RNA, 1617 nt, Artificial Sequence
  derived and/or modified sequence opt5 from VP1__Norovirus_and/or_Norovirus-like__KX514215
augaagauggccagcaacgacgugaaucccuccgauggcucuaccgcuaaccuggucccugagguuaauaacgaagugauggcccucgagccgguggucggggcggcuaucgccgcccccguggcuggacagcaaaauguuauugacccuuggaucagaaacaauuucgugcaggcccccggcggggaauuuacagucagcccucggaacgcucccggagagauucugugguccgccccucuuggcccggggcugaaucccuaccucucucaccuggcgcgcauguauaacggauacgccggcggcuucgaagugcagguuauccuugcugggaaugccuuuacggcuggaaaaauuaucuucgccgcggugccucccaacuuuccuaccgagggccugaaucccagccaggucacaauguucccgcauaucauuguggaugugagacaacucgagccuguccugaucccccugccugacguucggaacaauuuuuaucacuacaaccaguccaacgauucuaccauuaagcucaucgccaugcuguauacaccccuucgcgcuaauaacgccggggacgauguguucaccgugagcugcagaguccugacacggcccuccccugacuuugauuucauuuuucucgugccgcccaccguugaaagccgcucuaaaccuuucuccgugcccguccugacggugcaggagaugaccaauagcagauuuccugcuacacuugacaagcuguucaccggacccucuuccacauucguugugcagccgcaaaacggccgguguaugaucgaugggguccuccugggaaccacgcagcugagcccugugaauauuugcacauuucgcggcgacgucacccaucccagagauucuccuaucuacacaaugaaccucgccucccccaauuggaacaauuaugacccuaccgaagagauccccgccccgcugggcaccccugacuucguggggaaaauucagggaaugcuuacacagacgaccaagggcgaggggagcacacggggacaccgcgcuaccguuuacgugggcuccgcgaacuacgcccccaagcuggggagaguccaauuugaaacagauaccacgaaugaccucgaugcucaucagaacacaaaauucacccccgugggaguugugcagggcggcgagucuccucaacggagcgaaccgcagcaguggguccugcccuccuauagcgggcgcgacaccccuaaugugcaccuugcccccgccguggcuccuacauuucccggagagcagcuccuguucuuuagaucuaccaucccuggcugugggggacaccccaacaugaaucuggauugccugcucccgcaagaauggguucagcauuucuaccaggaggccgcgccugcucaguccgacgucgcccugcuucgguuugugaaccccgauacaagcagagugcuguucgaguguaagcuccacaaaucuggcuaugucacgguggcccauaccgggcaacacgaccugguuauuccucccaacggcuacuuucgcuucgauagcugggugaaucaguuuuauacacuugcuccgaugggaaacggcaccgggcggaagagauga

SEQ ID NO: 30233 - RNA, 1617 nt, Artificial Sequence
  derived and/or modified sequence opt5 from VP1__Norovirus_and/or_Norovirus-like__KX514367
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaacgcuggcgaugacguuuucaccgugagcugcagagugcugacccggcccucuccugauuuugacuucauuuuucucgucccgcccacgguggaaucccgcagcaaaccuuucucuguucccgugcugaccgucgaggaaaugacaaacuccagauuuccugccacccuugauaagcuguucacagggcccagcucuaccuucgugguucagccgcagaauggacgguguaugaucgacggcgugcuccuggggacgacacaacuguccccugucaacauuugcaccuuucgcggagaugugacacaucccagagacagcccuaucuacaccaugaaucucgccucccccaacuggaauaacuaugacccuaccgaggagauccccgcuccgcugggcacaccugauuucgucggcaaaauucaggggaugcuuacgcagaccacaaagggagaaggcucuacccgggggcaccgcgcgacaguguacguuggaagcgccgacuacgcucccaagcugggcagagugcaguuugagaccgauacgacaaaugaccucgaugcccaucaaaacaccaaauucacccccgucggggugguucagggaggcgaauccccuaagggcagcgagccgcagcaaugggugcugcccucucacuccgggcgggacacaccuaauguccaccuugcccccgcuguggccccuaccuuucccggagaacagcuccuguucuuucgcagcacaaucccuggcugugggggacaucccaacaugaaucuggauugccugcucccgcaggagugggugcagcacuucuaucaagaggcggcuccugcccagucugacguugcccugcuuagauuugucaaccccgauacgagccgggugcuguucgaauguaaacuccauaaguccggcuacgugaccgucgcucacacagggcagcacgaccuggugauuccucccaauggcuauuuuagauucgauucuuggguuaaccaguuuuacacccuugccccgaugggaaauggcacagggcgcaaacgguga

SEQ ID NO: 30234 - RNA, 1617 nt, Artificial Sequence
  derived and/or modified sequence opt5 from VP1__Norovirus_and/or_Norovirus-like__KX514243
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaacgccggcgaugacguuuucaccguguccugcagagugcugacacggcccagcccugauuuugacuucauuuuucucgucccgcccaccguggaaucucgcuccaaaccuuucagcguucccgugcugacggucgaggaaaugaccaauucuagauuuccugccacacuugauaagcuguucaccgggcccuccagcaaccucgugguucagccgcagaauggacgguguaugaucgacggcgugcugcuggggacaacccaacucucuccugucaacauuugcacguuccgcggagaugugacacaucccagagacuccccuaucuacaccaugaaucuggcuagccccaacuggaacuccuaugacccuacagaggagacccccgcgccgcuuggcaccccugauuuugucggcaaaauccacgggaugcugacacagacgacccagggaucuggcagcacacgggcccaucgcgcuaccguguacguugggggagccgaguucacacccaagcucggcaaggugcaguuuaaaaccgaaacggaccacgaucuguccauuagacaaaauacaaaguucacccccgucggggugguucagggaggcgaaagcccucagcggucugagccgcaacagugggugcuucccuccuacagcggccgcgacaccccuaauguccaccuggcccccgcuguggccccuacauuucccggggaacagcuccuguucuuuagaucuaccaucccuggauguggcgggcaucccaacaugaaucuggauugccuccugccgcaggagugggugcaacacuucuaucaggaggcggcuccugcccagagcgacguugcccuucugcgguuugucaaccccgauacauccagaguccucuucgaauguaaacugcauaagucuggauacgugacgguggcucacaccggccagcacgaccuugugauuccucccaauggguauuuucgcuucgauagcuggguuaaccaauuuuacacacuggccccgaugggcaauggaaccggccggaaaagauga

SEQ ID NO: 30235 - RNA, 1617 nt, Artificial Sequence
  derived and/or modified sequence opt5 from VP1__Norovirus_and/or_Norovirus-like__KX353996
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauacccauaacgugcaccuggcccccgccgucgcuccuacauuucccggcgagcagcuucuguucuuuagaagcaccaugccuggguguucuggauaucccaauauggaucucgaccggcugccuccccaggaaagagugcaauacuucuaucaggaggccgcgccggcucagagcgauguggcccugcuccgcuuuguuaacccugacacaggccggguccuguucgagugcaaacuucacaaguccggguacgugaccguggcccauacgggacagcacgaucuggucauucccccuaacggcuauuuuagauucgacucuugggugaaucaauucuacacccucgcucccauggggaacggcacaggacgccggagauga

SEQ ID NO: 30236 - RNA, 1617 nt, Artificial Sequence
  derived and/or modified sequence opt5 from VP1__Norovirus_and/or_Norovirus-like__DQ078820
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugggccccucccaggugacaauguucccgcauaucauugucgacgugagacaacucgagccugugcugaucccccugcucgauguccggaacaaucuguaucacuacaaccagucuaaugacccuaccauuaaacuuaucgcuaugcuguauacaccccuccgcgccaacaacgcuggggaaguuguguuuaccgugagcugcagaguccugacacggcccuccccugauuucgacuuuauuuuccuugugccgcccaccguugagagccgcacgaagccuuuuaccgugcccauccugacagccgaagagaugaccaauucuagauucccuacaccccucggaaagcuguuuaccggcccguccagcgccuucgucgugcagccucagaacgggcggugugcuacggauggaguucugcucggcacaacccaacugucucccgugaauauuugcacauuccgcggcgacgucacccauaucgcggggacccacgauuacacaaugaaccuugccucccagaauuggaacaauuaugacccuacggaggaaauccccgcuccucugggaacccccgauuuugugggcaaaauucaggggguccucacacagaccacaagaggagacggcagcacccgggggcauaaggccacggugucuacaggauccguucacuucaccccgaagcugggcggcgugcaauuuaccacagacaccaacaaugauuucgagacagggcagaacacgaaauuuaccccugucggagugauccaggacggcaauagcacacaccaaaacgaaccccagcaguggguucuucccaauuacuccgggcgcaccggacauaacgugcaccuggccccugcugucgccccgacauuccccggcgagcagcuccuguuuuucagaucuaccaugccuggguguagcggcuaccccaauaugaaccuggauugccuccugccucaagaaugggugcagcauuuuuaucaggaggcggcucccgcccaguccgacguggcccuucugcgguucguuaacccugaugcuggacgcguccucuuugaguguaagccccacaaaagcggcuacgugacgguggcccacaccgggcaacaugaccuggucauuccgccuaauggauauuucagauuugauucuugggugaaccaguucugcacacuugcucccaugggcaaugggaccggacggagacgcuga

SEQ ID NO: 30237 - RNA, 1617 nt, Artificial Sequence
  derived and/or modified sequence opt5 from VP1__Norovirus_and/or_Norovirus-like__AB933738
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucuucccucuggcccgcaaagucaagggguaugcuggaggcuuugaagugcagguuauccuugccggcaaggcuuuccccgccgggaaaauuaucuuugcggccucuccucccaacuucccgacggagggacugagcccuucccaggugaccauguuuccccacaucauugucgacgugagacaacucgagccugugcugaucccccugcccgauguccggaauaacuucuaccauuauaaucagucuaacgacagcacaauuaaacucaucgcuaugcuguacaccccucuucgcgccaauaacgcuggcgaagauguuuuuacaguguccugcagagugcugacccggccgagccccgacuucgauuuuauuuuccucgucccucccacaguggagucucgcaccaagccuuuuuccguucccauccugacgguggaagagaugaccaacagcagauucccgauuccucuugagaagcuguucacagggcccucuuccaccuuugucgugcagccucagaauggacgguguacaaccgacggcguucuccuggggacgacacaacugagccccgugaacaucugcaccuuccgcggagaugucacacacaucgccggcucuagaaauuauaccaugaaccucgccucccagaauuggaacagcuacgacccuaccgaagagauucccgcuccgcugggcacaccugauuuuguggggaaaauccagggaguccuuacgcagaccacacggcgcgacggcuccaccagagggcauaaggcgacaguguauaccggaucugccgacuucagccccaaacugggccggguucaauuugcuacggauacagacaaugauuucgacacccaccagaacaccaaguuuacacccgugggggucauucaggauggaggcaccgcccaucgcaaugaaccucaacagugggugcucccguccuacagcggcagaaacacacacaauguucaccuggcccccgcuguggccccuacguuccccggggagcagcuucuguuuuuccggucuaccaugccuggauguuccggcuaccccaacauggaccucgauugccugcugccucaggaauggguccaauauuuuuaccaggaggcggcucccgcccagagcgacguggcccuccugagauucgugaauccggauacagggcgcguucuuuuugaguguaaacugcauaagucuggauaugucaccguggcucacacaggccagcaugaccucgugaucccucccaacggguacuuccgguucgauagcugggucaaucaauuuuauacccuggccccuaugggcaacggaacgggcagacgccgguga

SEQ ID NO: 30238 - RNA, 1617 nt, Artificial Sequence
  derived and/or modified sequence opt5 from VP1__Norovirus_and/or_Norovirus-like__EU780734
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcauucauuuuacccaguccugggcuguuuucaauucuccucugauccaggccaugacccucaagcuggccaaaacaagagauagcccccaauccguggucgugcaggacggcagcaccacacaccagaacgagccccagcaauggguucuuccugauuacucugggcgggacuccuacaaugugcaccuggcuccggccgucgcgcccacguuuccuggagaacagcuccuguucuuucgcagcaccaugcccggcuguucuggcuauccuaacaugaaucuggauugccuccugccccaggagugggugcagcauuucuaccaagaaagcgcuccugcccaguccgacguggcccuucugagauuuguuaaccccgauacagggcggguccucuucgaguguaagcugcacaaaucuggauaugugaccguggcucauacaggccagcacgaccuugucauuccgccuaauggguacuuuagauucgauagcugggugaaccaguuuuauacccuggcccccaugggaaacggcgcugggcgccggagauga

SEQ ID NO: 30239 - RNA, 1617 nt, Artificial Sequence
  derived and/or modified sequence opt5 from VP1__Norovirus_and/or_Norovirus-like__KP064096
auggccagcaaggacgcucccaccaacauggauggcacauccggggccggacagcuggugccugaggcgaauacggcugaaccgaucucuauggagcccgucgccggcgccguuaccgcugccgcuacagccgggcaagugaacaugauugacccuuggaucaugaauaacuacgugcaggcgccccagggagaguucaccauuagcccuaauaacacacccggcgauauccucuuugaccugcagcuugggccucaccugaauccguuccucucccaucuggcccaaauguauaacggaugggucggcaauaugaaagugagaguucuucuggcuggcaacgccuuuaccgcugggaagauuaucaucucuugcauucccccuggauucguggcccagaauaucagcauugcgcaggccacaauguuuccccacgucaucgcugaugugcggguucucgaaccuauugaagugccccuggaggacguccgcaacgugcuguuccauaauaacgauaauaccccgacgaugagacucguguguauccuguacaccccucuucgggccuccggcucuagcuccgggacagaccccuuugucauugcuggacgcguucugaccugcccuagccccgauuucucuuuucucuuccuggugcccccuaacguggagcagaaaacaaagccguuuuccguccccaaccuuccucugaauacccucagcaacucuagagugcccucccugaucaaaagcaugaugguuucucgggaccacggccaaauggugcaguuccagaaugggcgcgucacgcuggauggacagcuccaaggcacaaccccuacauccgccagccagcuguguaagaucagaggcuccguguuucaugccaacgggggaaauggcuauaaccuuaccgaacuggacgggucucccuaccacgcuuucgagagcccggcgccuauuggauuccccgaucucggcgaaugcgacuggcacauggaggccuccccuaccacacaguuuaauacgggggacguuaucaagcaaauuaacgugaaacaggagagcgcuuucgcuccccaucugggaaccauccaggccgauggccuuucugacgucuccgugaauacaaacaugauugccaagcugggcugggucagcccugugucugaugggcacaaacgggacguugaucccugggugaucccgcgcuauggaagcacccucacagaagccgcgcagcuggcuccucccaucuaucccccuggcuuuggggaggccauugucuucuuuauguccgacuucccgaucgcccauggaaccaauggccugucugugcccuguacgauuccucaagaauuuguuacacacuucgugaacgagcaggcucccaccagaggggaagccgcucuccugcacuaccuugauccugacacccaucggaaucugggcgaguuuaagcucuaccccgauggauucaugacaugcgucccuaacaccagcggcacagggccccagacgcugccgaucaauggaguguuuguguucguuuccugggucagccgcuuuuaccagcuuaaaccugugggcaccgccgggcccgcgagacggcuguga

SEQ ID NO: 30240 - RNA, 1617 nt, Artificial Sequence
  derived and/or modified sequence opt5 from VP1__Norovirus_and/or_Norovirus-like__KC473548
augaugauggccagcaaggacgcucccaccaacauggauggcacauccggggccggacagcuggugccugaggcgaauacggcugaaccgcuccccaucaaaccugucgccggcgccgcuaccgccguugcuacagccgggcaagugaacaugauugaccccuggaucaugaauaacuucgugcaggcgccucagggagaguuuaccauuucucccaauaacacaccuggcgauauccuguucgaccuucagcuggggccgcaccucaaucccuuucuggcccaucuuagcagaauguacaacggaugggucggcaauaugcaagugcggauuaugcuggcuggcaacgccuucuccgcugggaagaucaucguuugcuguauuccucccggauuuucuagccaguccaucucuauugcccaggcgaccauguucccucacgugaucgccgauguccgcgugcucgaacccauugacguuccgcuggaugacgugagaaauguccuguuucauaacaaugauaacccucagacaaugcggcuccugugcaugcuuuauacgccccugcgcagcggcgggaccuccagcggaaccgacccuuucgugaucgcuggcagagugcucacaugucccacccccgauuuuucuuuccuguuucuugucccuccggacauugagcaacggacaaaacccuucuccguuccuaauauccccaugaaccugaugagcaacucucgcguguccaugcucaucgaugggaugauggugagcaaugaccagaaccaggucccucaguuucaaaauggaagagugacccuggacggccagcugcagggcacgacaaccguuucugccgcuugcguggcccggaugcgcgggagaauuuucaacaauaacggaaauuacggcgucaaccucacagaacuggaugggaaucccuaucacgccuucgacuccccggcuccucuuggauuucccgauuucggcaacugugaccugcauaugaccuuugugaagaucaauccuaacgagcucagcuccggggaucccucuggaaaaguugugauucggagcuacgacgcgaccuucgccccucaccugggcacagucaaacuugagaaugaugacgaacuggcucgcuuugugggcaaggaggucgugcucgaacugacguggguuuccaacagagagggggccacccugaaucucugggccgugcccaacuauggaagcucucugacacaggcuucccaacuugccccgccuaucuacccucccggcuucggggaggcgauugucuauuuuaccagcacauuccccaccgugucuaacccgaagguucccugcacgcugccucaggaauuugugagccacuucgucaaugagcaggcucccacacggggagaugccgcccuccugcauuacguggacccugauacccaccgcaaccuuggcgaauuuaagauguaccccgagggguauaugaccugugugccuaaugcuggcggaggcccccaaacacugccgaucaacgggguuuucgucuuuaucuccugggugucuagauacuaucagcucaaaccugugggaaccgccggcgcugcccggagacuguga

SEQ ID NO: 30241 - RNA, 1617 nt, Artificial Sequence
  derived and/or modified sequence opt5 from VP1__Norovirus_and/or_Norovirus-like__AB684698
auggccagcaaggacgcucccuccaacauggauggcaccucuggggccggacagcuggugccugaggcgaauacagcugaaccgaucaacauggagagcgucguuggcgccgccacggcuaccgccacagcugggcaagugaaucucauugaccccuggaucaugaacaauuacgugcaggccccucagggagaguucaccauuucccccaacaauacaccuggcgauguccuguuugaccuucagcuggggccccaccucaacccuuuccugucucaucuuagcagaauguauaauggaugggugggcaacaugaaaguucgggugaugcuggcgggcaaugccuuuuccgcugggaagaucauuaucugcuguaucccgcccggauucaccucucaaagcauuuccaucgcccaggcuacaauguuuccucacgucauugccgaugugcgcguucucgaacccaucgacgugccucuggaugacgucagaaacgugcuguuccauaauaacgauaaugcgcagaccaugcggcuccugugcaugcuuuacacgccccugcgcaccggcgccuccucuuccgggagcgacccguuugugauugcuggaagaguccucacauguccuacccaggauuucaacuuucuguuccuuguucccccugacguggaacagaaaacaaagcccuuuucugugcccaacaucccucugaaucucauguccaacagccgggucccggcccugauugauggcaugaccgugucuuccgaccaaaaucagguugugcaguuccaaaacgggcgcgucacgcuggacggacagcuccagggcacaaccgcugugagcgccuccugcguugccaaaaucagaggccggaucuuuucuaaugcuagccacuaugggauuaaccugacagagguggauggaacccaauaccaugcguucgacucccccgccccucuuggcuuccccgauuuugggaauugugacuggcacgucaccggaacaaaggcuagccagggcgaucugcagacggacaacccuaccaucucugggacaauuaaguccuaugagagcucuuucgcuccccaccucggaaccgugcgcaucgaaggcgaugacaaugagcuggccagauuuaacggcaaagauguccuucugaaucucacaugguucagccagcggaacgggucccaacugaaucuguggaccauuccgucuuacggaagcaaccucacggaagcuagccagcuggccccucccaucuauccucccggcuuuggggaggcgaucguguacuucacaagcaccuuuccugcuauuucucgccccuccguuccgugcaccaugccucaggaguucgugagccauuuugucaaugaacaggcccccacaagaggagaggccgcccuucugcacuaccucgaccccgauacccaucggaaccugggcgaguucaagauguauccugaaggguuuuucacaugugugccgaacgccggcggaucuggcccccaaacgcuuccuaucaaugggguuuuuguguucgucuccugggugagccgcuacuaucagcugaaacccgugggaaccguuggcaugacaagacggcucuga

SEQ ID NO: 30242 - RNA, 1617 nt, Artificial Sequence
  derived and/or modified sequence opt5 from VP1__Norovirus_and/or_Norovirus-like__AF538679
augaagauggccagcaaagacgcucccaccaacauggauggcacauccggggccggacagcuggugccuggcgcgaauacggcugagccgcuccccaucaagccugucgccggggccgcuaccgccguugcuacagccggacaagugaacaugauugaccccuggaucaugaauaacuucgugcaggcgccucagggcgaauuuaccauuucucccaauaacacaccuggggauauccuguucgaccuucagcugggaccgcaccucaaucccuuucuggcccaucuuagcagaauguacaacggcugggucggcaauaugcaagugcggauuaugcuggcugggaacgccuucuccgcuggaaaaaucaucguuugcuguauuccucccggcuuuucuagccaguccaucucuauugcccaggcgaccauguucccucacgugaucgccgauguccgcgugcucgagcccauugacguuccgcuggaugacgugagaaauguccuguuucauaacaaugauaacccucagacaaugcggcuccugugcaugcuuuauacgccccugcgcagcgggggagcuuccagcggcaccgacccuuucgugaucgccgggagagugcucaccugucccacacccgauuuuucuuuccuguuucuugucccuccggacauugaacaacggaccaagcccuucuccguuccuaauauccccaugaaccugaugagcaacucucgcgugccuaugcucaucgauggaaugaugguguccaaugaccagaaccaggucccccaguuucaaaauggcagagugacacuggacggccagcugcaggggaccacgacaguuagcgcugccugcauugcccggaugcgcggaagaaucuucaacaauaacggcaauuacggggugaaccucgcugagcuggauggaaauccguaucacgcguucgacucuccugcuccccuuggcuuuccugauuucgggaacugugaccugcauaugaccuuugucaaaauuaaucccacagaacucuccaccggagauccuagcggcaaggugguuauccacuccuacgacgccaccuucgcuccccaccugggcacagugaaacuugaggauaacaaugagcuggaccaauuugucgggaaggaagugguccucgagcugacgugggugucuaaccggaccggagccacacugaaucucugggccguuccgaacuauggcagcaaccugacccaggccucccagcuugcgccucccauuuaucccccuggguucggagaagcuaucguguacuuuacaagcaccuucccgacggucucuaaucccaaggugccuugcacacugccccaggaguuuguuucccauuucgugaacgagcaagccccuacccgcggcgaugccgcucuccugcacuacgucgaccccgauacccauagaaaucuuggggaauuuaaaauguacccugagggcuauaugacaugugugcccaacgccggaggcgggccgcagacccugccuaucaauggaguguucguuuuuauuagcugggucucucgguacuaucagcucaagcccgugggcacagcuggggccgcgcgcagacuguga

SEQ ID NO: 30243 - RNA, 1617 nt, Artificial Sequence
  derived and/or modified sequence opt5 from VP1__Norovirus_and/or_Norovirus-like__JQ743332
augaugauggccagcaaggacgcuucccagucugccgauggcgcgagcggggcuggacaacuggugcccgaggucaacaccgccgacccucucccgauggaacccguugccggcccuacaacggcuguggccaccgcuggacaggugaauaugaucgaucccuggauugucaacaauuucgugcaguccccucagggggaguuuacaaucucucccaacaauaccccuggcgacauucuguucgaucuucaacuggggccgcaccucaaccccuuucugagccaucuuucccagauguacaauggauggguuggcaacaugagagugcggauccugcucgccggcaaugcguucucugccgggaaaauuaucgucugcugugugccucccggauuuacaagcuccagccugaccaucgcucaggccacacuguucccucacguuauugcugacgugcgcacccucgaacccaucgagaugccgcuggaagaugucagaaacgugcuuuaucauacgaaugacaaccagccuaccaugcggcuggugugcaugcucuacacaccccugcgcaccggcgggggaucuggcaauuccgauagcuuugucguugccgggagagugcuuacagcgccuucuuccgacuucagcuuucuguuccucgugccucccaccauugagcaaaagacgcgggccuuuacaguccccaacaucccgcugcagacccugucuaauucccgcuuccccagccucauucagggaaugauccuguccccugaugcuucucaggugguucaauuucagaacggcagaugucuuauugacggccagcugcucgggacaacccccgccaccagcggacaacuguuccgggugcgcggcaaaaucaaccagggggcuagaacacuuaaucugacggaggucgauggaaagccuuucauggccuuugacucccccgccccggugggcuucccugacuuugggaaaugcgauuggcacaugcggaucagcaagacccccaacaauacaucuuccggagacccuaugcgcagcguuucugugcagaccaacguccagggcuucgugccccaucucggcagcauucaauuugaugaagucuucaaucacccuacaggggacuauaucggaaccauugaguggaucucccagcccucuacgccgccuggcacagauauuaaccugugggaaauccccgacuacgggagcucccugagccaggcugcgaaucucgcucccccuguguuuccgcccggauucggcgaggcccugguuuauuuugugucugccuucccugggcccaacaauagauccgccccuaacgauguccccugucuucugccucaggaguacaucacccacuuugugagcgaacaagcucccaccaugggcgacgccgcgcuccugcauuauguugauccggacacaaaucggaaccuuggagaguucaagcuguacccuggcggguaccugaccugcgugcccaauggagucggcgcugggccucagcagcucccccugaacggaguguuucucuucgugucuuggguuucccgcuucuaucagcugaaaccggucggcacagccagcacggccagauga

SEQ ID NO: 30244 - RNA, 1617 nt, Artificial Sequence
  derived and/or modified sequence opt5 from VP1__Norovirus_and/or_Norovirus-like__GQ856470
augaugauggccagcaaggacgcucccaccaacauggauggcacauccggggccggacagcuggugccugaggucucuacggcggaaccgaucagcauggagcccguugcuggcgccgccaccgcugccgcuacagccgggcaagugaauaugauugacccuuggaucauguccaacuacgugcaggcgccccagggagaguucaccauuucuccuaauaacacacccggcgauauccucuuugaccugcagcuugggccucaccugaauccguuccucagccaucuggcccaaauguauaacggaugggucggcaauaugaaagugagaguucuucuggcuggcaacgccuuuaccgcugggaagauuaucaucuccugcgugcccccuggauucgccgcgcagaaugucucuauugcccaggcuacaauguuuccccacgugaucgccgauguucgggugcucgaaccuauugaagucccccuggaggacgugcgcaacgugcuguuccauaauaacgauagcaccccgacgaugagacucaucuguaugcuguacaccccucuucgggcuuccggcucuagcuccgggacagaccccuuugucauugccggacgcguucugaccugcccuagccccgauuucaauuuucucuuccuggugcccccuaacguggagcagaaaacaaagccguuuucuguccccgaccuuccucugaaugugcucuccaacagcagaguucccucucugaucaaauccaugauggugagccaagaucacggccagaugguccaguuccagaacgggcgggugacccuggacggacaacuccagggcacgacaccuaccuccgccucucagcuguguaagauucgcggcacaguuuaucaugcuaccgggggacaaggccuuaaucugaccgaaaucgaugggacacccuaccacgcguuugagagcccggccccuaucggauuccccgaccucggcgaaugcgacuggcacauuaacgcuuccccugccaaugccuucacggaugggagcaucauucauagaaucgacgugguccaggaucccaccuuugcuccucaccugggaacaauucauuauaccaacgccaauuacgacgcgaacgugucucuuaucuguucccuggaguggcucagcccgccgucuggcggcgcucugaaggccaauccuugggccaucccccgguaugggagcacacugaccgaggcugcccagcucgcucccccuauuuacccgcccggauucggcgaagccaucgucuuuuucauguccgauuuuccuauugcgaacgggucugacggacugagcgugcccugcacgaucccucaggaguucguuacacacuuugugaaugaacaagcccccacccgcggcgaggcugcccuucugcacuacgucgauccugacacccauagaaaccucggggaguucaaacuguaucccgaaggcuuuaugacaugugugcccaauuccagcggaucuggcccucagacccuucccauuaacgggguuuucacauuuaucuccugggugagccgguucuaccagcugaagccugucggaacgaccggccccgugcgcagacucuga

SEQ ID NO: 30245 - RNA, 1617 nt, Artificial Sequence
  derived and/or modified sequence opt5 from VP1__Norovirus_and/or_Norovirus-like__JN603244
augaugauggccagcaaggacgcucccaccaacauggauggcacauccggggccggacagcuggugccugaggucucuacggcggaaccgaucagcauggagcccguugcuggcgccgccaccgcugccgcuacagccgggcaagugaauaugauugacccuuggaucauguccaacuacgugcaggcgccccagggagaguucaccauuucuccuaauaacacacccggcgauauccucuuugaccugcagcuugggccucaccugaauccguuccucagccaucuggcccaaauguauaacggaugggucggcaauaugaaagugagaguucuucuggcuggcaacgccuuuaccgcugggaagauuaucaucuccugcgugcccccuggauucgccgcgcagaaugucucuauugcccaggcuacaauguuuccccacgugaucgccgauguucgggugcucgaaccuauugaagucccccuggaggacgugcgcaacgugcuguuccauaauaacgauagcaccccgacgaugagacucaucuguaugcuguacaccccucuucgggcuuccggcucuagcuccgggacagaccccuuugucauugccggacgcguucugaccugcccuagccccgauuucaauuuucucuuccuggugcccccuaacguggagcagaaaacaaagccguuuucuguccccaaucuuccucugaacgugcucuccaacagcagaguucccucucugaucaaauccaugauggugagccaagaccacggccagaugguccaguuccagaaugggcgggugacccuggauggacaacuccagggcacgacaccuaccuccgccucucagcuguguaagauucgcggcacaguuuaucaugcuaccgggggacaaggccuuaaccugaccgaaaucgacgggacacccuaccacgcguuugagagcccggccccuaucggauuccccgaucucggcgaaugcgacuggcacauuaaugcuuccccugccaacgccuucacggacgggagcaucauucauagaaucgauguggcucaggacucuaccuuugcgccccaccugggaacaauucauuauaccaaugccgauuacaacgcuaaugucggccuuaucuguucccuggaguggcucagcccucccucuggcggggccccgaaggugaacccuugggccaucccccgguauggaagcacacugaccgaggcugcccagcuggcucccccuauuuacccgcccggcuucggggaagccaucgucuuuuucauguccgacuuuccuauugcgaauggaucugauggccucagcgugcccugcacgaucccucaggaguucguuacacacuuugugaacgaacaagcccccacccgcggggaggcugcccugcuucacuacgucgacccugauacccauagaaaucugggcgaguucaaacucuaucccgaaggauuuaugacaugugugccgaacuccagcggcucugggccucagacccugcccauuaauggaguuuucacauuuaucuccugggugagccgguucuaccagcuuaagccugucggcacgaccgggcccgugcgcagacuguga

SEQ ID NO: 30246 - RNA, 1617 nt, Artificial Sequence
  derived and/or modified sequence opt5 from VP1__Norovirus_and/or_Norovirus-like__AB078335
augaugauggccagcaaggacgcuccccaguccgccgauggcgcgucuggggcuggacaacuggugccugaggucaacaccgccgacccgcuccccauggaaccuguugccggccccacaacggcuguggccaccgcuggacaggugaauaugaucgauccuuggauugucaacaauuucgugcagagcccccagggggaguuuacaaucuccccuaacaauaccccgggcgacauucuguucgaucuucaacuggggccccaccucaacccuuuucugucucaucuuagccagauguacaauggauggguuggcaacaugagagugcggauccugcucgccggcaaugcguucuccgccgggaaaauuaucgucugcugugugcccccuggauuuacaucuagcucccugaccaucgcucaggccacacuguucccccacguuauugcugacgugcgcacccucgaaccgaucgagaugccucuggaagaugucagaaacgugcuuuaucauacgaaugacaaccagcccaccaugcggcuggugugcaugcucuacacaccucugcgcaccggcgggggaagcggcaauucugauuccuuugucguugccgggagagugcuuacagcgcccagcucugacuucuccuuucuguuccucgugcccccuaccauugagcaaaagacgcgggccuuuacagucccgaacaucccccugcagacccugagcaauucucgcuucccuucccucauucagggaaugauccugagccccgaugcuucccaggugguucaauuucagaacggcagaugucuuauugacggccagcugcucgggacaaccccugccaccucuggacaacuguuccgggugcgcggcaaaaucaaccagggggcuagaacacuuaaucugacggaggucgauggaaagcccuucauggccuuugacagcccggccccugugggcuuccccgacuuugggaaaugcgauuggcacaugcggaucuccaagaccccuaacaauacaagcucuggagaccccaugcgcuccguuagcgugcagaccaacguccagggcuucgugccucaucucggcucuauucaauuugaugaagucuucaaucaccccacaggggacuauaucggaaccauugaguggaucagccagccguccacgccucccggcacagauauuaaccugugggaaauccccgacuacgggucuagccugucccaggcugcgaaucucgccccuccgguguuucccccuggauucggcgaggcucugguuuauuuugugagcgccuuccccgggccuaacaauagaucugcccccaacgaugucccuugucuucugccccaggaguacaucacccacuuuguguccgaacaagcuccgaccaugggcgacgccgcgcuccugcauuauguugauccugacacaaaucggaaccuuggagaguucaagcuguaccccggcggguaccugaccugcgugccuaauggagucggcgcugggccccagcagcucccgcugaacggaguguuucucuucgugagcuggguuucucgcuucuaucagcugaaaccugucggcacagccuccacggccagauga

SEQ ID NO: 30247 - RNA, 1617 nt, Artificial Sequence
  derived and/or modified sequence opt5 from VP1__Norovirus_and/or_Norovirus-like__GU299761
augaugauggccagcaaggacgcucccaccaacauggauggcacauccggggccggacagcuggugccugaggcgaauacggcugaaccgcuccccaucaaaccugucgccggcgccgcuaccgccguugcuacagccgggcaagugaacaugauugaccccuggaucaugaauaacuucgugcaggcgccucagggagaguuuaccauuucucccaauaacacaccuggcgauauccuguucgaccuucagcuggggccgcaccucaaucccuuucuggcccaucuuagcagaauguacaacggaugggucggcaauaugcaagugcggauuaugcuggcuggcaacgccuucuccgcugggaagaucaucguuugcuguauuccucccggauuuucuagccaguccaucucuauugcccaggcgaccauguucccucacgugaucgccgauguccgcgugcucgaacccauugacguuccgcuggaugacgugagaaauguccuguuucauaacaaugauaacccucagacaaugcggcuccugugcaugcuuuauacgccccugcgcagcggcgggaccuccagcggaaccgacccuuucgugaucgcuggcagagugcucacaugucccacccccgauuuuucuuuccuguuucuugucccuccggacauugagcaacggacaaaacccuucuccguuccuaauauccccaugaaccugaugagcaacucucgcguguccaugcucaucgaugggaugauggugagcaaugaccagaaccaggucccucaguuucaaaauggaagagugacccuggacggccagcugcagggcacgacaaccguuucugccgcuugcguggcccggaugcgcgggagaauuuucaacaauaacggaaauuacggcgucaaccucacagaacuggaugggaaucccuaucacgccuucgacuccccggcuccucuuggauuucccgauuucggcaacugugaccugcauaugaccuuugugaagaucaauccuaacgagcucagcuccggggaucccucuggaaaaguugugauucacagcuacgacgcgaccuucgccccucaccugggcacagucaaacuugagaaugaugacgaacuggcucgguuugugggcaaggaggucgugcucgaacugacguggguuuccaaccgcgagggggccacccugaaucucugggccgugcccaacuauggaagcucucugacacaggcuucccaacuugccccgccuaucuacccucccggcuucggggaggcgauugucuauuuuaccagcacauuccccaccgugucuaacccgaagguucccugcacgcugccucaggaauuugugagccauuucgucaaugagcaggcucccacaagaggagaugccgcccuccugcacuacguggacccugauacccaucggaaccuuggcgaauuuaagauguaccccgagggguauaugaccugugugccuaaugcuggcggaggcccccaaacacugccgaucaacgggguuuucgucuuuaucuccugggugucucgcuacuaucagcucaaaccugugggaaccgccggcgcugccagacggcuguga

SEQ ID NO: 30248 - RNA, 1617 nt, Artificial Sequence
  derived and/or modified sequence opt5 from VP1__Norovirus_and/or_Norovirus-like__AJ277610
augaugauggccagcaagggcgcuccccaguccgccgacgggucuagcggagcgggccaacuggugccugaggucaacaccgcugauccgcuccccauggaaccuguugccgggcccacaacggccguggcuaccgccggacaggugaauaugaucgacccuuggauugucaacaauuucgugcagucuccccagggcgaguuuacaaucuccccuaacaauaccccgggggauauucuguucgaccuucaacugggaccccaccucaacccuuuucugagccaucuuucccagauguacaauggcuggguuggcaacaugagagugcggauccugcucgcugggaaugccuucucugcgggaaaaauuaucgucugcugugugcccccuggcuuuacaagcuccagccugaccaucgcccaggcuacacuguucccccacguuauugccgaugugcgcacccucgaaccgaucgagaugccucuggaagacgucagaaacgugcuuuaucauacgaaugauucucagcccaccaugcggcuggugugcaugcucuacacaccucugcgcaccgggggaggcuccgggaacagcgacucuuuugucguugcuggaagagugcuuacagcccccuccagcgauuucucuuuucuguuccucgugcccccuaccauugagcaaaagacgcgggcguuuacagucccgaauaucccccugcagacccuguccaacagccgcuucccuucccucauucagggcaugauccugucucccgacgccagccaggugguucaauuucagaauggcagaugucuuauugaugggcagcugcucggaacaaccccugcuaccuccggccaacuguuccgggugcgcgggaaaaucaaccagggagccagaacacuuaaccugacggaggucgacggcaagcccuucauggcuuuugauagcccggccccugugggguuccccgacuuuggaaaaugcgacuggcacaugcggguuucuaagaccccuaauaacacauccagcggcgaucccaugcgcucugugagcguccagaccaaugugcagggcuucgucccucaucucggguccauccaauuugacgaaguguucaaccaccccacaggagauuauauuggcaccaucgaguggauuucucagccgagcacgccucuggggacagacaucaaucugugggaaauucccgauuacggauccagccucucucaggccgcuaaccuggcgcccccuguuuuuccgcccggcuucggggaggcccuuguguauuuugucuccgcuuucccuggccccaauaacagaagcgccccuaaugacgugcccugucugcucccucaggaguacaucacccacuuuguuucugaacaagcccccaccaugggagaugcugcccugcuucauuauguggacccggauacaaaccggaaucugggcgaguucaagcucuacccugggggauaccugaccugcguccccaacggcgugggggcgggaccucagcagcugccccucaauggcguguuucuguucguuuccugggucagccgcuucuaucagcuuaaaccgguggggacagcuuccacggccagauga

SEQ ID NO: 30249 - RNA, 1617 nt, Artificial Sequence
  derived and/or modified sequence opt5 from VP1__Norovirus_and/or_Norovirus-like__GQ856462
augaugauggccagcaaggacgcucccaccaacauggauggcacauccggggccggacagcuggugccugaggcgaauacggcugaaccgcuccccaucaaaccugucgccggcgccgcuaccgccguugcuacagccgggcaagugaacaugauugaccccuggaucaugaauaacuucgugcaggcgccucagggagaguuuaccauuucucccaauaacacaccuggcgauauccuguucgaccuucagcuggggccgcaccucaaucccuuucuggcccaucuuagcagaauguacaacggaugggucggcaauaugcaagugcggauuaugcuggcuggcaacgccuucuccgcugggaagaucaucguuugcuguauuccucccggauuuucuagccaguccaucucuauugcccaggcgaccauguucccucacgugaucgccgauguccgcgugcucgaacccauugacguuccgcuggaugacgugagaaauguccuguuucauaacaaugauaacccucagacaaugcggcuccugugcaugcuuuauacgccccugcgcagcggcgggaccuccagcggaaccgacccuuucgugaucgcuggcagagugcucacaugucccacccccgauuuuucuuuccuguuucuugucccuccggacauugagcaacggacaaaacccuucuccguuccuaauauccccaugaaccugaugagcaacucucgcguguccaugcucaucgaugggaugauggugagcaaugaccagaaccaggucccucaguuucaaaauggaagagugacccuggacggccagcugcaggauacgacaaccguuucugccgcuugcguggcccggaugcgcggcagaauuuucaacaauaacgggaauuacggagucaaccucacagaacuggacggcaaucccuaucacgccuucgauuccccggcuccucuuggguuucccgacuucggaaacugugaucugcauaugaccuuugugaagaucaauccuaacgagcucagcuccggcgaccccucugggaaaguugugauucacagcuacgaugcgaccuucgccccucaccugggaacagucaaacuugagaaugacgaugaacuggcucgguuugugggcaaggaggucgugcucgaacugacguggguuuccaaccgcgagggcgccacccugaaucucugggccgugcccaacuaugggagcucucugacacaggcuucccaacuugccccgccuaucuacccucccggauucggcgaggcgauugucuauuuuaccagcacauuccccaccgugucuaacccgaagguucccugcacgcugccucaggaauuugugagccauuucgucaaugagcaggcucccacaagaggggacgccgcccuccugcacuacguggauccugacacccaucggaaccuuggagaauuuaagauguaccccgagggcuauaugaccugugugccuaaugcugggggcggaccccaaacacugccgaucaacggcguuuucgucuuuaucuccugggugucucgcuacuaucagcucaaaccuguggggaccgccggagcugccagacggcuguga

SEQ ID NO: 30250 - RNA, 1617 nt, Artificial Sequence
  derived and/or modified sequence opt5 from VP1__Norovirus_and/or_Norovirus-like__AF435807
augaagauggccagcaaagacgcuccccaguccgccgauggcgcgucuggggcuggacaacuggugccugaggucaacaccgccgacccgcuccccauggaaccuguugccggccccacaacggcuguggccaccgcuggacaggugaauaugacagauccuuggaucgucaacaauuucgugcagagcccccagggggaguuuaccauuuccccuaacaauacaccgggcgacauccuguucgaucuucaacuggggccccaccucaacccuuuucugucucaucuuagccagauguacaauggauggguuggcaacaugagagugcggauucugcucgccggcaaugcguucuccgccgggaagaucauugucugcugugugcccccuggauuuaccucuagcucccugacaaucgcucaggccacccuguucccccacguuaucgcugacgugcgcacgcucgaaccgauugagaugccucuggaagaugucagaaacgugcuuuaucauaccaaugacaaccagcccacaaugcggcuggugugcaugcucuacaccccucugcgcacaggcgggggaagcggcgauucugacuccuuugucguugccgggaaagugcuuaccgcgcccagcucugauuucuccuuucuguuccucgugcccccuacgaucgagcaaaagacaagagccuuuaccgucccgaauauuccccugcagacacugagcaacucucgguucccuucccucauccagggaaugauucugagccccgacgcuucccaggugguucaauuucagaauggccgcugucuuaucgauggccagcugcucgggaccaccccugccacaucuggacaacuguucagagugcggggcaaaauuaaccagggggcucgcacgcuuaaccugaccgaggucgacggaaagcccuucauggccuuugacagcccggccccugugggcuuccccgauuuugggaagugcgacuggcacaugagaaucuccaaaacaccuaauaacaccagcucuggagaucccaugcgguccguuagcgugcagacaaauguccagggcuucgugccucaucucggcucuauccaauuugacgaagucuucaaccaccccaccggggauuauauuggaacgaucgaguggauuagccagccguccacaccucccggcaccgacaucaaucugugggaaauucccgauuacgggucuagccugucccaggcugcgaaccucgccccuccgguguuucccccuggauucggcgaggcucugguuuauuuugugagcgccuuccccgggccuaauaaccgcucugcccccaaugacgucccuugucuucugccccaggaguacaucacccacuuuguguccgaacaagcuccgacaaugggcgaugccgcgcuccugcauuauguugacccugauaccaacagaaaucuuggagaguucaagcuguaccccggcggguaccucacaugcgugccuaacggagucggcgcugggccccagcagcugccgcugaauggaguguuucucuucgugagcuggguuucucgguucuaucagcugaaaccugucggcacggccuccaccgcccgcuga

SEQ ID NO: 30251 - RNA, 1617 nt, Artificial Sequence
  derived and/or modified sequence opt5 from VP1__Norovirus_and/or_Norovirus-like__KX396056
augaugauggccagcaaggacgcucccaccaacauggauggcacauccggggccggacagcuggugccugaggcgucuacggcugaaccgaucagcauggagcccgucgccggcgccgcuaccgccgcugccacagcggggcaaguuaauaugauugacccuuggaucauguccaacuacgugcaggcuccccagggagaguucaccauuucuccuaauaacacacccggcgauauccucuuugaccugcagcuugggccucaccugaauccguuccucagccaucuggcucaaauguauaacggaugggugggcaauaugaaagucagagugcuucuggccggcaacgcuuuuaccgccgggaagauuaucaucuccugcguucccccuggauucgcggcccagaaugugucuauugcucaggccacaauguuuccccacgucaucgcugaugugcggguucucgaaccuauugaagugccccuggaggacguccgcaacgugcuguuccauaauaacgauagcaccccgacgaugagacucaucuguaugcuguacaccccucuucgggccuccggcucuagcuccgggacagaccccuuugugauugccggacgcguccugaccugcccuagccccgauuucaauuuucucuuccugguucccccuaacguggagcagaaaacaaagccguuuucugugcccaaucuuccucugaacguccucuccaacagcagagugcccucucugauccgguccaugaugguuagccaagaccacggccagauggugcaguuccagaaugggcgcgucacccuggauggacaacuccagggcacgacaccuaccuccgcuucucagcuguguaaaauuagaggcacaguguaucaugcgaccgggggacaaggccuuaaccugaccgaaaucgacgggacacccuaccacgcccucgagagcccggcuccuaucggauuucccgaucugggcgaaugcgacuggcacauuaaugccuccccugccaacgcuuucacggacgggagcaucauucaucggaucgauguugcccaggacucuaccuucgcgccccaccuuggaacaauucauuauaccaaugcuaacuacgaugccaauaucucccugaucuguagccucgaguggcugucuccucccagcggcggcgccccgaaggugaacccuugggcuauuccccgcuauggguccacacugaccgaggccgcucagcucgcgcccccuaucuacccgcccggauuuggcgaagccauugucuucuuuaugucugacuucccuaucgccaaugggagcgauggacuguccgugcccugcacgauuccucaggaguuugucacacacuucgugaacgaacaagcucccaccagaggcgaggccgcccuucugcacuacguugacccugauacccaucggaaucucggggaauuuaagcuguaucccgagggcuucaugacaugugugccgaacagcucuggauccggcccucagacccuucccaucaauggggucuuuacauucaucagcugggugucucgcuuuuaccagcugaaaccuguuggaacgaccggccccgugagacggcucuga

SEQ ID NO: 30252 - RNA, 1617 nt, Artificial Sequence
  derived and/or modified sequence opt5 from VP1__Norovirus_and/or_Norovirus-like__AB187514
augaugauggccagcaaggacgcucccaccaacauggauggcacauccggggccggacagcuggugccugaggcgucuacggcugaaccgaucagcauggagcccgucgccggcgccgcuaccgccgcugccacagcggggcaaguuaauaugauugacccuuggaucauguccaacuacgugcaggcuccccagggagaguucaccauuucuccuaauaacacacccggcgauauccucuuugaccugcagcuugggccucaccugaauccguuccucagccaucuggcccaaauguauaacggaugggugggcaauaugaaagucagagugcuucuggccggcaacgcuuuuaccgccgggaagauuaucaucuccugcguucccccuggauucgcggcccagaaugugucuauugcucaggccacaauguuuccccacgucaucgcugaugugcggguucucgaaccuauugaagugccccuggaggacguccgcaacgugcuguuccauaauaacgauagcaccccgacgaugagacucaucuguaugcuguacaccccucuucgggccuccggcucuagcuccgggacagaccccuuugugauugccggacgcguccugaccugcccuagccccgauuucaauuuucucuuccugguucccccuaacguggagcagaaaacaaagccguuuucugugcccaaucuuccucugaacguccucuccaacagcagagugcccucucugaucaaauccaugaugguuagccaagaccacggccagauggugcauuuccagauugggcgggucacccuggauggacagcuccaaggcacgacaccuaccuccgcuucucagcuguguaagauccgcggcacaguguaucacgcgaccgggggacagggccuuaaucugaccgaaaucgacgggacacccuaccacgccuuugagagcccggcuccuauuggauuccccgaucucggcgaaugcgacuggcauaucaacgccuccccugccaaugcuuucacggacgggagcauuauccacagaauugauguugcccaagacucuaccuuugcgccccaucugggaacaauccacuauaccaacgcuaauuacgaugccaacgugucccuuaucuguagccuggaguggcucucuccucccagcggcggcgccccgaaggucaauccuugggcuauuccccgguauggguccacacugaccgaggccgcucagcuggcgcccccuaucuacccgcccggauucggcgaagccauuguguuuuucaugucugacuuuccuaucgccaacgggagcgauggacucuccguccccugcacgauuccucaggaguucgugacacacuuuguuaaugaacaggcucccacccgcggcgaggccgcucugcuucauuacguggacccugauacccacagaaaccugggggaguucaaacucuaucccgaaggcuuuaugacaugugucccgaauagcucuggauccggcccucaaacccugcccaucaacgggguguucacauuuaucagcuggguuucucgguucuaccagcuuaagccugugggaacgaccggccccguccgcagacuguga

SEQ ID NO: 30253 - RNA, 1617 nt, Artificial Sequence
  derived and/or modified sequence opt5 from VP1__Norovirus_and/or_Norovirus-like__L07418
augaugauggccagcaaggacgcuccccaguccgccgauggcgcgucuggggcuggacaacuggugccugaggucaacaccgccgacccgcuccccauggaaccuguugccggccccacaacggcuguggccaccgcuggacaggugaauaugaucgauccuuggauugucaacaauuucgugcagagcccccagggggaguuuacaaucuccccuaacaauaccccgggcgacauucuguucgaucuucaacuggggccccaccucaacccuuuucugucucaucuuagccagauguacaauggauggguuggcaacaugagagugcggauccugcucgccggcaaugcguucuccgccgggaaaauuaucgucugcugugugcccccuggauuuacaucuagcucccugaccaucgcucaggccacacuguucccccacguuauugcugacgugcgcacccucgaaccgaucgagaugccucuggaagaugucagaaacgugcuuuaucauacgaaugacaaccagcccaccaugcggcuggugugcaugcucuacacaccucugcgcaccggcgggggaagcggcaauucugauuccuuugucguugccgggagagugcuuacagcgcccagcucugacuucuccuuucuguuccucgugcccccuaccauugagcaaaagacgcgggccuuuacagucccgaacaucccccugcagacccugagcaauucucgcuucccuucccucauucagggaaugauccugagccccgaugcuucccaggugguucaauuucagaacggcagaugucuuauugacggccagcugcucgggacaaccccugccaccucuggacaacuguuccgggugcgcggcaaaaucaaccagggggcuagaacacuuaaucugacggaggucgauggaaagcccuucauggccuuugacagcccggccccugugggcuuccccgacuuugggaaaugcgauuggcacaugcggaucuccaagaccccuaacaauacaggaagcggcgaccccaugcgcucuguuuccgugcagaccaacguccagggcuucgugccucaucucgggagcauucaauuugaugaagucuucaaucaccccacaggagacuauaucggcaccauugaguggaucucucagccgagcacgccucccgggacagauauuaaccugugggaaauccccgacuacggauccucucugagccaggcugcgaaucucgccccuccgguguuucccccuggcuucggggaggcucugguuuauuuuguguccgccuuccccggcccuaacaauagaagcgcccccaacgaugucccuugucuucugccccaggaguacaucacccacuuugugucugaacaagcuccgaccaugggagacgccgcgcuccugcauuauguugauccugacacaaaucggaaccuuggcgaguucaagcuguaccccgggggauaccugaccugcgugccuaauggcgucggggcuggaccccagcagcucccgcugaacggcguguuucucuucguguccuggguuagccgcuucuaucagcugaaaccugucgggacagccucuacggccagauga

SEQ ID NO: 30254 - RNA, 1617 nt, Artificial Sequence
  derived and/or modified sequence opt5 from VP1__Norovirus_and/or_Norovirus-like__FJ515294
augaugauggccagcaaggacgcuccccaguccgccgauggcgcgucuggggcuggacaacuggugccugaggucaacaccgccgacccgcuccccauggaaccuguugccggccccacaacggcuguggccaccgcuggacaggugaauaugaucgauccuuggauugucaacaauuucgugcagagcccccagggggaguuuacaaucuccccuaacaauaccccgggcgacauucuguucgaucuucaacuggggccccaccucaacccuuuucugucucaucuuagccagauguacaauggauggguuggcaacaugagagugcggauccugcucgccggcaaugcguucuccgccgggaaaauuaucgucugcugugugcccccuggauuuacaucuagcucccugaccaucgcucaggccacacuguucccccacguuauugcugacgugcgcacccucgaaccgaucgagaugccucuggaagaugucagaaacgugcuuuaucauacgaaugacaaccagcccaccaugcggcuggugugcaugcucuacacaccucugcgcaccggcgggggaagcggcaauucugauuccuuugucguugccgggagagugcuuacagcgcccagcucugacuucuccuuucuguuccucgugcccccuaccauugagcaaaagacgcgggccuuuacagucccgaacaucccccugcagacccugagcaauucucgcuucccuucccucauucagggaaugauccugagccccgaugcuucccaggugguucaauuucagaacggcagaugucuuauugacggccagcugcucgggacaaccccugccaccucuggacaacuguuccgggugcgcggcaaaaucaaccagggggcuagaacacuuaaucugacggaggucgauggaaagcccuucauggccuuugacagcccggccccugugggcuuccccgacuuugggaaaugcgauuggcacaugcggaucuccaagaccccuaacaauacaagcucuggagaccccaugcgcuccguugaugugcagaccgacguccagggcuucgugccucaucucggcagcauucaauuugaugaagucuucaaccaccccacaggggacuauaucggaaccauugaguggaucucucagccgagcacgccucccggcacagauauuaaucugugggaaauccccgacuacggguccucucugagccaggcugcgaaccucgccccuccgguguuucccccuggauucggcgaggcucugguuuauuuuguguccgccuuccccgggccuaauaacagaagcgcccccaaugaugucccuugucuucugccccaggaguacgugacccacuuuguuucugaacaagcuccgaccaugggcgacgccgcgcuccugcauuauguggauccugacacaaaccggaaucuuggagaguucaagcuguaccccggcggguaccugaccugcgucccuaacggagugggcgcugggccccagcagcucccgcugaauggaguguuucucuucguuuccugggucagccgcuucuaucagcugaaaccugugggcacagccucuacggccagauga

SEQ ID NO: 30255 - RNA, 1617 nt, Artificial Sequence
  derived and/or modified sequence opt5 from VP1__Norovirus_and/or_Norovirus-like__KJ790198
augagaauggccagcgacgaugcuaaguccgcccccucugaccuggagggcgcggggcucgugccugcuaccgccgccccgcugcccgucgcuccuguugccggagcucaggccgcggaacccuucgccggccaaaucaacgugauugauccuuggaucuacacaaauuuugugcaggcucccacgggggaguucaccgucagcccucggaacacaccgggagaagugcuuguuaaucuggagauuggccccaaccucaauccuuaucugcagcaccuugcccagauguacaacggguaugcuggaggcguggaaguccaagugauccuggccggcaaugcguuuaccgccgggaaacuccugugcgcucugguucccccuggauuccccacauccucuauuaccccggcccagcucacaaugcugccucauaccaucaucgacgugcgcacgaccgaucccgucguggugccuaugcccgacgucagacggacacuuuggcacgagguucgcagcaccacagagccccugaugagacucgugauuaugcuguacaccccuaugcgggcuaacuccggcucugaugaagccuuuguggucagcgggcgcgugcuuuccagaccggcccccgacuucaacuuuuucuaucugguuccuccccggguggaggauacggucgaaccuuuuagccuccccgaccugcgcguggaugagaugucuuccagcagauggcagaauccgguugugaugcugcaggcugacccuaaucaaaacaucgcggcccauuggcagaauggacgguguacaauuaacggcgagcuccuggggaccacaccccgcaaucagucuuggcuucugagaaugcggggauccguccucgcugccccuggcggccagaaggccgugaccgucaacguggaucugaccgaacccgacgggcaggcuuucagcguucuuucuggaaacccuggccccgagggggugccggacuuucaggccaucuacaauguccgcauguccacagcgagcacgaccgcuggacacacaguggccaccaacggcuauauugaacaguccggguacaccccugcccugggaacacucguuauccaaggcguggaucugucucagguccccgcucugggcagcgaggugacgaugcaagugguuuccauugaccucaaucauaacauggaucccacaagacugccugacuacaauggggccggauucgauggcagcgucgcucuugccccgccccuggugccuccccucccuggggaagugcugcuucgguuuaccacccugcccaucacaaccucuagaggauccagcgucucugcgacacucgacugcgcccugccugcugaguggaucacgugguuccuggugcacaacuucguuccccagggcgaugccgcucuccugcgcuaucggaauagagggaccggccaaauucuuuuugaguguaaacuguacaaggaaggauuccucgccguggcgggcgucagcacacgcaccguguuuccgacauccgggguuuucgaguuugugucuugggucccuguguucuaucagcugacccccguuggaagcuccggcgcccggaaaagauga

SEQ ID NO: 30256 - RNA, 1617 nt, Artificial Sequence
  derived and/or modified sequence opt5 from VP1__Norovirus_and/or_Norovirus-like__KF306212
augaugauggccagcaaggacgcuccccaguccgccgauggcgcgucuggggcuggacaacuggugccugaggucaacaccgccgacccgcuccccauggaaccuguugccggccccacaacggcuguggccaccgcuggccaggugaauaugaucgauccuuggauugucaacaauuucgugcagagcccccagggagaguuuacaaucuccccuaacaauaccccgggcgacauucuguucgaucuucaacuggggccccaccucaacccuuuucugucucaucuuagccagauguacaauggauggguuggcaacaugagagugcggauccugcucgccggcaaugcguucuccgccgggaaaauuaucgucugcuuugugcccccuggauucacaucuagcucccugaccaucgcucaggccacacuguuuccccacguuauugcugacgugcgcacccucgaaccgaucgagaugccucuggaagaugucagaaacgugcuuuaucauacgaaugacaaccagcccaccaugcggcugguguguaugcucuacacaccucugcgcaccggcgggggaagcgggucuuccgauagcuucgucguugccgggagagugcuuacagcgcccucuuccgacuuuagcuuccuguuucucgugcccccuaccauugagcaaaagacgcgggccuucacagucccgaauaucccccugcagacccugucuaacucccgcuuuccuagccucauucagggaaugauccugucccccgaugcuucucaggugguucaauuccagaauggcagaugccuuauugacggccagcugcucgggacaaccccugccaccagcggacaacuguuccgggugcgcggcaaaaucaaccagggggcuagaacacuuaaccugacggaggucgauggaaagcccuuuauggccuucgacuccccggccccugugggcuuucccgacuucgggaaaugugauuggcacaugcggaucagcaagaccccuaauaacacaucuuccggagaccccaugcgcagcguuucugugcagaccaauguccagggcuuugugccucaucucggcagcauucaauucgaugaagucuuuaaccaccccacaggggacuauaucggaaccauugaguggaucucccagccgucuacgccucccggcacagauauuaaucugugggaaauccccgacuacgggagcucccugagccaggcugcgaaccucgccccuccgguguuucccccuggauucggcgaggcucugguuuauuucgugucugccuuucccgggccuaauaacagauccgcccccaaugaugucccuugccuucugccccaggaguacaucacccacuucgugagcgaacaagcuccgaccaugggcgacgccgcgcuccugcauuauguugauccugacacaaaccggaaucuuggagaguuuaagcuguaccccggcggguaccucaccugugugccuaacggagucggcgcugggccccagcagcugccgcugaauggaguguuccucuucgugucuuggguuucccgcuuuuaucagcugaaaccugucggcacagccagcacggccagauga

SEQ ID NO: 30257 - RNA, 1617 nt, Artificial Sequence
  derived and/or modified sequence opt5 from VP1__Norovirus_and/or_Norovirus-like__KM461694
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggauaacaucuccgcggcccagaucacgaugugcccucacgucauuguggacgugagacagcuggaacccguccugcucccgcugccugauauccggaaucgcuuuuuccauuauaaccaggaggacacccccagaaugcggcuuguugcuaugcuguacacaccucuccgcgccaauucuggggaagauguguuuaccgugagcuguagaguccugacacggcccgcucccgacuucgaguuuaccuuccuugugccuccgacaguugaguccaagaccaaacccuuuacgcugccuauucucacccugggagaacugagcaacucucgcuuccccgccgccaucgauaugcucuauacagacccuaacgaguccauugugguccaaccccagaauggcagaugcacccuggaugggacacuucagggaaccacgcagcuggugccgacacaaaucugugcuuuucggggcacccucauuagccagaacgcgcgcgccgcugaccugacagauucuccucagagagcccggaaucacccccuucauguucaagugaagaaccuggacgggacccaguacgacccuaccgaugacauccccgccguccucggagcuaucgauuucaaaggcacaguguucggcgucgccucccagcgcgacgugagcgggacgcaggaacaaggacacuaugcgaccagagcucacgaggcccauauugauacaaccgacccuaaguacgcccccaagcugggcacaauccugauuaaaucugaauccaccgauuuuacgacaaaucagccgauccgguucaccccuguugggaugggagacaacaauuggagacagugggagcuccccgauuacagcggcucccugacccuuaacaugaaucuggcucccgccgugucuccuagcuuuccgggggagcgcauucucuucuuucgguccaucguccccagcgcuggaggcuauggcucuggguacaucgacugccugauuccucaggaaugggugcaacacuucuaucaggaggccgcgcccucccagagcgccguugcucuugugagauacgucaacccugauacaggacgcaauaucuuugaagccaagcugcaucgggagggcuuccucaccguggcuaacucugggaauaaccccauugugguuccucccaauggauauuuuagauucgaagccugggucaaccaguuuuacacacuggcguga

SEQ ID NO: 30258 - RNA, 1614 nt, Artificial Sequence
  derived and/or modified sequence opt5 from VP1__Norovirus_and/or_Norovirus-like__AB039780
augaagauggccagcaacgacgcugcccccuccaaugauggcgcggcugggcuggugccugaaaucaaccacgaagucauggccauugagccgguugccggagcuucucucgccgcucccguggugggccagcugaauaucauugacccuuggaucagaaacaauuucguccaagcccccgcgggggaauuuaccgugagcccucggaacgcccccggagaguuccuucuggaucucgaacugggcccugagcuuaauccguaccuggcucaucucgcccgcauguauaacgggcacgcuggaggcauggagguucagauugugcuggccggcaaugcguuuacagccgggaaaauccuguucgcugucauucccccuggauuucccuacgaaaaccucuccccugcccagcugacgaugugcccccaugugguuguggacgucagacagcuugagccgauccugcucccuaugcccgauauccggaauaccuucuuucacuauaaccaaucuaauggcccuaagcugcgccuuguggcuaugcuguacacaccccucagagccaacaaugccggggaagacguguucaccgucagcugucggguucugacacgccccuccccugauuuugaguucaacuuucuggugccgcccucuguggagagcaaaaccaaggcuuucacacucccuauucugaaaaucuccgaaaugaccaacagcagauuucccauuccugucgaccagauguauacgucucggaaugagaacaucgugguucagccccagaauggacgcgugacccuugauggcgaacugcaagggacaaccacacuccagccggucuccauuugcggauucagaggcacccugcagacgcggcuugcggaccagccuaacuacacauaucaagugcaucuggagaaucucgauggcagccccguugacccuaccgaugaagugcccgccccucuggggacacccgacuuccaggcucagcuguuuggagucaucucucaacgcuccagcgacaacgccaccagagcccacgaggcucgggugaauaccaacgauccgacauucgccccucagaucgcgcagguccgcuuuaagucucccuccaaugacuucuuugauaacgagcccauuaaguucacgccugugggcaucagcguugacucccaaaauucuuacaaccaguggcuccugccgagauacgggggacaccuuaccaauaacacacaucuggcucccagcguguccccuauguuucccggcgaacagauucucuucuuucggagcuucaugccuggggccucuggacacaccgauggcgccaucgacugucugcuuccccaggagugggucgcucauuuuuaucaggaagccgcuacagcccaaaccgauguggcgcugauuagauucguuaauccugacacgggccgcgugcucuuugaggggaaacugcacaagcagggauucaucacaaucuccaacagcggcgaucaccccauugucaugccggccaacggguacuuccgguuugaggcuugggugaaucaguucuauucucuggccccugugggaaccggcagcgggagacgccggauccaguga

SEQ ID NO: 30259 - RNA, 1614 nt, Artificial Sequence
  derived and/or modified sequence opt5 from VP1__Norovirus_and/or_Norovirus-like__AY038599
augaagauggccagcaacgacgcugcccccuccucugauggcgcggcugggguggucccugaaaucaaucacgaaguuauggccauugagccgguggccggagcuagcaucgccgcucccguggucggccagcaaaacauuaucgacccuuggauuagaaauaacuucgugcaggcccccgcgggggaauuuaccguuuccccucggaaugcccccggagaguuccugcucgaucuggaacuuggcccugaccugaacccguaccucgcucaucuggcccgcauguauaaugggcacgcuggaggcauggaggugcagaucguccuugccggcaacgcguuuacagccgggaaaauccuguucgcugugauucccccuggauuucccuacgagaaucucugcccugcccagcugacgauguguccccauguuguggucgaugugagacaacuggaaccggugaugcucccuaugcccgacauccggaacaccuucuuucacuauaaucaggauggcgggccuaagcugcgccuuauugcuaugcuguacacaccccucagagccaacaauucuggagacgaugucuucaccguuagcugccgggugcugacacgccccgccccugacuuugaguucaccuuucuugugccgcccuccaucgaaucuaaaacaaaggcuuucaccauuccuguccugaaaaucagcgagaugacgaacuccagauuucccgugccuguugaucagauguauaccagccggucugagggcauugugguccagccccaaaaugggcgcgcgacaaucgacggagaacuccugggcaccacacugguguccccgguuagcguguguaacuucaagggcaaccuccaggccgaggucccugggcagcaucagcuguaccaacuucagcugaccaaucucgauggaucucccaucgacccuacggacgauacacccggcccucuggggugccccgacuucaccggacuucuguauggcguggcuucccagagagggccgggagaugccacacgggcccacgaagcucgcauugacaccggcagcgauaccuuugccccuaagaucggccaagucagauucuacucuacauccagcgacuuugagacgaaccagcccacccacuucacacccauugggaucuacauugaaggaaauuccucugauuuuaaccaguggcagcucccucgguauggcgggcaucuggcgaauaacaaucaccuggcuccggccgugagcccccucuucccuggagagcaaauccuguuuuuccgcuccuuuauccccggcgccagcgggcauaccaacggcgagauggacugucuucugccucaggaguucguucagcacuuuuaccaggaagcugccacagcuagaucugaaguggcccuccugcgguucgucaaucccgauaccggcagagcgcuuuuugaguccaaacugcacaagcaaggauucaugacgauugccagcucuggggaccauccuaucauuaugcccacaaacggauauuuccgcuuugaggcuugggugaaucaguucuacagccucgccccgguuggcaccggguccggacggagacgcauccaguga

SEQ ID NO: 30260 - RNA, 1614 nt, Artificial Sequence
  derived and/or modified sequence opt5 from VP1__Norovirus_and/or_Norovirus-like__AY054299
augaagauggccagcaacgacgcugcccccuccucugauggcgcggcugggcuggugccugagaucaaucacgaagucauggccauugagccgguugccggagcuagcaucgccgcucccguggugggccagcaaaacauuaucgacccuuggauuagaaauaacuucguccaggcccccgcgggggaauuuaccguguccccucggaaugcccccggagaguuccuccuggaucuugaacugggcccugaccucaacccguaccuggcucaucuugcccgcauguauaaugggcacgcuggaggcauggagguucagaucgugcuggccggcaacgcguuuacagccgggaaaauccucuucgcugucauucccccuggauuucccuacgagaaucugucuccugcccagcugacgaugugcccccaugugguuguggaugucagacaacucgaaccggugaugcugccuaugcccgacauccggaacaccuucuuucacuauaaucaggauggcgggccucgccuuagacugauugcuaugcucuacacaccccugcgggccaacaauagcggagacgauguguucaccgucuccugucgcguucuuacaagacccgccccugacuuugaguucaccuuucuggugccgcccucuaucgaaagcaagacaaaggcuuucaccauuccugugcucaaaaucuccgagaugacgaacagccgguuucccgucccuguggaucagauguauaccucucgcuccgagggcauuguugugcagccccaaaaugggagagcgacaaucgacggagaacugcugggcaccacacucgucagcccggugucuguuugcaacuucaaaggcaaccugcaggccgaggugccuggggaacaucagcuuuaccagcugcaacucaccaaucuggauggaucccccaucgacccuacggacgauacacccggcccucuugggugucccgacuucaccggacugcucuauggcgucgcuagccagcgggggccgggagaugccacacgcgcccacgaggcuagaauugacaccggcucugauaccuacgccccuaagaucggccaggugcgguuuuacuccacaagcuccaacuucgaacgcaaucaacccacgcacuuuacccccauugggaucuauauugagggaaacucuagcgacuucaaucaguggcagcugccuagauacggcgggcaucuggcgaacaauaaccaccucgcuccggccgucagcccccuguuuccuggagagcagauccuuuucuuucgguccuucauccccggcgccucugggcauacaaauggcgaaauggauugccugcucccucaagaguuugugcagcacuucuaucaggaagcugccaccgcucaguccgagguugcccugcuuagauuugugaaccccgacacaggacgcguccuguucgaaagcaagcuccacaaacaaggcuuuaugaccauugcgucuagcggggaucauccuaucauuaugcccacgaauggauacuuccgguucgaggccugggugaaccaguuuuauucccuggcuccgguuggcacagggucuggaagacgccggauccaguga

SEQ ID NO: 30261 - RNA, 1614 nt, Artificial Sequence
  derived and/or modified sequence opt5 from VP1__Norovirus_and/or_Norovirus-like__AF195848
augaagauggccagcaacgacgcugcccccuccaaugauggcgcggcugggcuggugccugagaucaaccacgaagucauggccauugagccgguugccggagcuucucucgccgcucccguggugggccagcugaauaucauugacccuuggaucagaaacaauuucguccaagcccccgcgggggaauuuaccgugagcccucggaacgcccccggagaguuccuucuggaucucgaacugggcccugagcuuaauccguaccuggcucaucucgcccgcauguauaacgggcacgcuggaggcauggagguucagauugugcuggccggcaaugcguuuacagccgggaaaauccuguucgcugucauucccccuggauuucccuacgaaaaccucuccccugcccagcugacgaugugcccccaugugguuguggacgucagacagcuugagccgauccugcucccuaugcccgauauccggaauaccuucuuucacuauaaccaaucuaauggcccuaagcgcagacugguggcuaugcuuuacacaccccugcgggccaacaaugccggggacgauguguucaccgucagcugucgcguucucacaagacccuccccugacuuugaguucaacuuucuggugccgcccucuguggaaagcaaaaccaaggcuuucacacugccuguccucaaaauuuccgagaugaccaacagccgguuucccaucccuguggaucagauguauacgucucgcaaugaaaacauuguugugcagccccagaauggaagagucacccuggacggcgagcuucaagggacaaccacacugcagccgguguccaucugcggauuccggggcacccuccagacgcgccuggcggaucagccuaacuacacauaucaaguucaucuugaaaaucuggacggcagccccguggauccuaccgacgagguccccgccccucucgggacacccgacuuccaggcucagcuguuuggagugauuucucaaagauccagcgauaacgccacccgggcccacgaagcucgcgucaauaccaacgacccgacauucgccccucagaucgcucaggugagauuuaagucucccuccacggauuucagcgacaaugagcccaucaaguuuaccccuguuggcauuuccguggauucucagaacagcuacaaucaauggcugcucccgcgguacgggggacaccugacaaacaauacccaucuugcgcccuccgucagcccuauguuccccggcgagcagauccuguuuuucagaucuuuuaugccuggggccggaggcuucacagacggcgccauugauugucuccugccccaggaauggguggcucacuuuuaucaggaggccgcuaccgcccaaacggacguugcgcuuauccgcuucgugaacccugauacagggcggguccuguuugaaggaaaacuccauaagcagggcuucauuaccaucuccaauagcggggaccaccccaucgugaugccggccaacggauacuucagauuugaggcuugggugaaacaguucuauucucuggccccuguuggcaccgggagcggccgccggagaguccaguga

SEQ ID NO: 30262 - RNA, 1614 nt, Artificial Sequence
  derived and/or modified sequence opt5 from VP1__Norovirus_and/or_Norovirus-like__AB303927
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaagcaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugagcaauucuagauuuccugucccccuugagaagcuguacaccgggccguccagcgccuucgugguucagccucagaacggacgguguacaaccgauggcgugcuccuggggacgacacaacugucugccgucaauauuugcaccuuccgcggagacgugacacauaucgcuggcucccacgauuauaccaugaaccucgcgagccagaauuggaacaauuacgaccccaccgaggaaaucccugcuccccugggcacaccugacuuugucgggaaaauucagggagugcuuacgcagaccacaagagaggauggcuccacccgggcccauaaggccacaguuucuaccgggagcgugcacuucacgcccaagcugggauccguccaauacacaaccgacaccaacaaugauuuucagacaggccagaacaccaaauucacaccgguggggguuauccaagacggaagcaaucaccagaacgaaccucagcagugggugcuccccaauuauucuggccgcacgggccauaacguccaccuggcccccgcuguggccccuaccuuuccgggggagcaacuucuguucuuuagauccacaaugcccggauguagcggcuacccuaauaugaaccucgauugccugcugccccaggaaugggugcagcauuucuaucaggaggcggcuccugcccaaucugacguugcccuccugcgguuugucaaccccgauaccgggcgcgugcuuuucgaguguaagcugcacaaaagcggauacgugacagucgcucacaccggcccucaugaccucgugauucccccgaauggguauuuuagauucgauuccuggguuaaccaguuuuacacgcuggccccuaugggcaauggagcuggccggagacgcuga

SEQ ID NO: 30263 - RNA, 1614 nt, Artificial Sequence
  derived and/or modified sequence opt5 from VP1__Norovirus_and/or_Norovirus-like__AY038600
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaguuauuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugacuccaccaucaagcucauugcuaugcuguauacaccccuucgcgccaacaacgcuggcgaugacguguucaccgugagcugcagaguccugacacggcccucuccugauuuugacuucaucuuucucgugccgcccaccguugaaucccgcacgaaaccuuucaccgugcccauucugacagucgaggaaaugagcaauucuagauuuccuaucccccuugagaagcuguacaccgggccguccagcgccuucgugguucagccucagaacggacgguguacaaccgauggcgugcuccuggggacgacacaacugucugccgucaauauuugcaccuuccgcggagacgugacacauaucgcuggcucccacgauuauaucaugaaccucgcgagccagaauuggaacaauuacgaccccaccgaggaaauuccugcuccccugggcaccccugacuuugucgggaaaauccagggaaugcuuacacagacgaccagagaggauggcuccacacgggcccauaaggccaccgugucuacagggagcguucacuucacccccaagcugggauccgugcaauacacgacagacaccaacaaugaucuccagaccggccagaacacaaaauuuaccccggucggggugauucaagacggaaauaaccaccagaaugaaccucagcaguggguucugcccaacuauagcggccgcacaggccauaaugugcaccuugcccccgcugucgccccuacguucccgggggagcaacugcucuuuuucagaucuaccaugcccggauguuccggcuacccuaacaugaaccuggauugccugcucccccaggaaugggugcagcauuuuuaucaggaggcggcuccugcccaaagcgacguggcccugcuucgguucguuaaucccgauacagggcgcguccuguuugaguguaagcuccacaaaucuggauacgugaccguggcucacacaggcccucaugaccuggucauucccccgaacggguauuucagauuugauagcugggugaaucaguucuacacccuugccccuaugggcaacggagcuggccggagacgcuga

SEQ ID NO: 30264 - RNA, 1614 nt, Artificial Sequence
  derived and/or modified sequence opt5 from VP1__Norovirus_and/or_Norovirus-like__AF080554
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauaucgcuggcucucacgauuauaccaugaaucucgcgucccagaacuggaauaacuacgaccccaccgaggaaauuccugcuccccugggcacaccugacuuuguggggaaaauccagggaguccuuacgcagaccacaaaggaggauggcagcaccagagcccauaaggccacaguguccaccgggucuguucacuucacgcccaaacugggaagcgugcaauacacaaccgacaccaauaacgauuuucagacaggccagaauaccaaguucacaccggucggggugauucaagacggaaacaaucaccagaacgaaccucagcaguggguucuccccaauuauuccggccggacgggccauaacgugcaccuggcccccgcugucgccccuaccuuuccgggggagcaacuucuguucuuucgcagcacaaugcccggauguucuggcuacccuaacaugaaucucgauugccugcugccccaggaaugggugcagcauuucuaucaggaggcggcuccugcccaauccgacguggcccuccugagauuuguuaaccccgauaccgggcggguccuuuucgaguguaaacugcacaagagcggauacgugacaguggcucacaccggcccucaugaccucgucauucccccgaauggguauuuucgcuucgauucuugggugaaccaguuuuacacgcuggccccuaugggcaauggagcuggcagacggagauga

SEQ ID NO: 30265 - RNA, 1614 nt, Artificial Sequence
  derived and/or modified sequence opt5 from VP1__Norovirus_and/or_Norovirus-like__AB294778
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccugucccccuugagaagcuguacaccgggccgucuuccgccuucgugguucagccucagaauggacgguguacaaccgauggcgugcuccuggggacgacacaacugagcgccgucaacauuugcaccuuccgcggagacgugacacauaucgcuggcucucacgauuauaccaugaaucucgcgucccagaacuggaauaacuacgaccccaccgaggaaaucccugcuccccugggcacaccugacuuugucgggaaaauucagggagugcuuacgcagaccacaagagaggauggcagcacccgggcccauaaggccacaguuuccaccgggucugugcacuucacgcccaagcugggaagcguccaauacacaaccgacaccaauaacgauuuucagacaggccagaauaccaaauucacaccgguggggguuauccaagacggauccaaccaccagaaugaaccucagcagugggugcuccccaacuauagcggccgcacgggccauaauguccaccuggcccccgcuguggccccuaccuuuccgggggagcaacuucuguucuuuagaucuacaaugcccggauguuccggcuacccuaacaugaaccucgauugccugcugccccaggaaugggugcagcauuucuaucaggaggcggcuccugcccaaagcgacguugcccuccugcgguuugucaaucccgauaccgggcgcgugcuuuucgaguguaagcugcacaaaucuggauacgugacagucgcucacaccggcccucaugaccucgugauucccccgaacggguauuuuagauucgauagcuggguuaaucaguuuuacacgcuggccccuaugggcaacggagcuggccggagacgcuga

SEQ ID NO: 30266 - RNA, 1614 nt, Artificial Sequence
  derived and/or modified sequence opt5 from VP1__Norovirus_and/or_Norovirus-like__AB303922
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugaucgacccuuggaucagaagcaauuucguucaggcucccggcggggaauuuacgguguccccucggaacgcccccggagagauucuguggucugcgccucuuggcccggaucugaaucccuaccucagccaccuggcccgcauguauaacggguacgcuggaggcuucgaaguccaggugauccuugccggcaaugcuuuuaccgccgggaaaauuaucuucgcggccguuccucccaacuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaacgcuggcgaugacguuuucaccgugagcugcagagugcugacccggcccucuccugauuuugacuucauuuuucucgucccgcccacgguggaaucccgcaccaaaccuuucacaguucccauccugaccguggaggaaaugagcaacucuagauuuccuauuccccuugagaagcuguacacagggccguccagcgccuucgucgugcagccucagaauggacgguguaccacggauggcguucuccuggggacaacccaacugucugccgugaacaucugcacauuccgcggagacgucacccauaucgcuggcucccacgauuauaccaugaaucucgcgagccagaacuggaauaacuacgaccccacagaggaaauuccugcuccccugggcacgccugacuuuguggggaaaauccagggaguccuuacccagacaaccagaggcgauggguccacacgggcccauaaggccaccgugucuacgggaagcguucacuucacacccaagcugggcuccgugcaauacaccaccgacacaaauaacgauuuucagaccgggcagaauacaaaauucacgccggucggagugauucaagacggcgauaaccaccagaaugagccucagcaguggguucuccccaacuauagcggccgcaccgggcauaaugugcaccuggcccccgcugucgccccuacauuuccgggagaacaacuucuguucuuuagaucuaccaugcccggcuguuccggguacccuaacaugaaucucgacugccugcugccccaggagugggugcagcauuucuaucaggaagcggcuccugcccaaagcgauguggcccuccugcgguuuguuaaccccgacacaggacgcguccuuuucgaguguaagcugcacaaaucuggcuacgugaccguggcucacacggggccucaugaucucgucauucccccgaacggcuauuuuagauucgacagcugggugaaucaguuuuacacccuggccccuaugggaaacggcgcugggcggagacgcuga

SEQ ID NO: 30267 - RNA, 1614 nt, Artificial Sequence
  derived and/or modified sequence opt5 from VP1__Norovirus_and/or_Norovirus-like__AY532128
augaagauggccagcaacgacgcuaaucccuccgauggcucuaccgccaaccuggugccugaggucaauaacgaaguuauggcgcucgagccgguggugggggcugccaucgccgcucccgucgccggacagcaaaauaucaucgacccuuggauuagaaacaauuucgugcaggcucccggcggggaauuuacaguuagcccucggaacgcccccggagagauccugugguccgcgccucuuggcccggaucugaaucccuaccucucucaccuggcccgcauguauaacggguacgcuggaggcuucgaagugcaggucauucuugccggcaaugcuuuuacggccgggaaaaucaucuucgcggccgugccucccaacuuuccuaccgagggacugagccccucccagguuacaauguucccgcauauuaucguggacgucagacaacucgagccugugcugauuccccugccugaugugcggaauaacuuuuaucacuacaaucagucuaacgacagcaccaucaagcucauugcuaugcuguauacaccccuucgcgccaacaaugcuggcgaugacgucuucaccguuuccugcagagugcugacacggcccagcccugauuuugacuucaucuuucucgugccgcccaccgucgaaucucgcacgaaaccuuucaccgugcccauucugacaguugaggaaauguccaacagcagauuuccuaucccccuugagaagcuguacaccgggccgucuuccgccuucgugguccagccucagaauggacgguguacaaccgauggcgugcuccuggggacgacacaacugagcgccguuaacaucugcaccuuccgcggagacgugacacauauugcuggcucucacgauuauaccaugaaucucgcgucccagaacuggaauaacuacgaccccaccgaggaaaucccugcuccccugggcacaccugacuuugucgggaaaauucagggaauccuuacgcagaccacaagagaggauggcagcacccgggcccauaaggccacaguguccaccgggucuguccacuucacgcccaagcugggaagcgugcaauacacaaccgacaccaauaacgauuuucagacaggccagaauaccaaauucacaccgguuggggugauucaagacggaaacaaucaccagaacgaaccucagcaguggguccuccccuccuauagcggccgcacgggccauaaugugcaccuggcccccgcuguugccccuaccuuuccgggggagcaacuucuguucuuuagaucuacaaugcccggauguuccggcuacccuaacaugaaccucgauugccugcugccccaggaaugggugcagcauuucuaucaggaggcggcuccugcccaaagcgacgucgcccuccugcgguuugugaaucccgauaccgggcgcgugcuuuucgaguguaagcugcacaaaucuggauacguuacagucgcucacaccggcccucaugaccucgugauucccccgaacggguauuuuagauucgauagcugggugaaucaguuuuacacgcuggccccuaugggcaacggagcuggccggagacgcuga

SEQ ID NO: 30268 - RNA, 1614 nt, Artificial Sequence
  derived and/or modified sequence opt5 from VP1__Norovirus_and/or_Norovirus-like__AY532113
augaagauggccagcaacgacgcuaaucccuccgauggcucuaccgccaaccuggugccugaggucaauaacgaaguuauggcgcucgagccgguggugggggcugccaucgccgcucccgucgccggacagcaaaauauuaucgacccuuggauuagaaacaauuucgugcaggcucccggcggggaauuuacaguuagcccucggaacgcccccggagagauccugugguccgcgccucuuggcccggaucugaaucccuaccucucucaccuggcccgcauguauaacggguacgcuggaggcuucgaagugcaggucauucuugccggcaaugcuuuuacggccgggaaaaucaucuucgcggccgugccucccaacuuuccuaccgagggacugagccccucccagguuacaauguucccgcauauuaucguggacgucagacaacucgagccugugcugauuccccugccugaugugcggaauaacuuuuaucacuacaaucagucuaacgacagcaccaucaagcucauugcuaugcuguauacaccccuucgcgccaacaaugcuggcgaugacgucuucaccguuuccugcagagugcugacacggcccagcccugauuuugacuucaucuuucucgugccgcccaccgucgaaucucgcacgaaaccuuucaccgugcccauucugacaguugaggaaauguccaacagcagauuuccuaucccccuugagaagcuguacaccgggccgucuuccgccuucgugguccagccucagaauggacgguguacaaccgauggcgugcuccuggggacgacacaacugagcgccguuaacaucugcaccuuccgcggagacgugacacauauugcuggcucucacgauuauaccaugaaucucgcgucccagaacuggaauaacuacgaccccaccgaggaaaucccugcuccccugggcacaccugacuuugucgggaaaauucagggaaugcuuacgcagaccacaagagaggauggcagcacccgggcccauaaggccacaguguccaccgggucuguccacuucacgcccaagcugggaagcgugcaauacacaaccgacaccaauaacgauuuucagacaggccagaauaccaaauucacaccgguuggggugauccaagacggaaacaaucaccagaacgaaccucaucaguggguccuccccaauuauuccggccgcacgggccacaacgugcaucuggcccccgcuguugccccuaccuuuccgggggagcagcuucuguucuuuagaagcacaaugcccggauguucuggcuacccuaacaugaaucucgauugccugcugccccaagaaugggugcagcacuucuaucaggaggcggcuccugcccaguccgacgucgcccuccugcgguuugugaaccccgauaccgggcgcgugcuuuucgaguguaagcugcacaaaagcggauacguuacagucgcucauaccggcccucacgaccucgugauucccccgaauggguauuuuagauucgauucuugggugaaccaauuuuacacgcuggccccuaugggcaauggagcuggccggagacgcuga

SEQ ID NO: 30269 - RNA, 1614 nt, Artificial Sequence
  derived and/or modified sequence opt5 from VP1__Norovirus_and/or_Norovirus-like__EU078406
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacauuaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaaaucaucuucgcggccgugccucccaauuuuccuacggagggacugucucccagccagguuaccauguucccgcaugugauugucgacgugagacaacucgagccugugcugaucccccugccugauguccggaacaauuuuuaucacuacaaccaggcucaugaccccacaauuaagcucaucgccaugcuguauacaccccuucgcgcuaauaacgccggcgaugacguuuucaccguguccugcagagugcugacccggccuagcccggauuuugacuucauuuuucucgugcccccuacagucgaaucucgcaccaaacccuucacgguuccuauccugaccguggaggaaauguccaacagcagauuucccauuccgcuugagaagcuguacacagggccuucuuccgauuucgucgugcagccccagaauggacgguguaccacagacggcguucuccuggggaccacgcaacugagcgccgugaacaucugcaauuucaaaggagaugucacacacaucgcuggcucucgcgacuauagaaugaaccucgugucccagaauuggaacaauuacgacccuaccgaggaaauucccgcgccucugggcacacccgauuuucaggggaagauccagggacuucugacccaaaccacaggcgccgacgggagcacgcgggcucauaaggccaccgucuccacaggagccgcuaacuucaccccgaaacucggcucugugcaguuuacaaccgauacggacaaugauuuccagacagggcaaaacaccaaguuuaccccuguuggagugauucaggacggcagccaccaccagaaugagccccagcaauggguccugcccaacuacuccggccgcacagugcauaauguucaccuugccccugcgguggcuccgaccuuccccggggaacagcugcucuuuuucagaagcacaaugccuggauguucuggcuaucccaacaugaaucuggauugccugcucccucaggagugggucaugcauuuuuaccaggaagccgcccccgcucaauccgacguggcccugcuucgguucgugaacccugauacggggcgcguucuguuugaguguaaacuccacaaggcuggauauaucaccgucgcccacacaggccagcaugaccuggugauucccccgaacggguacuucagauuugauagcugggugaaucaguucuauacccuugcgccuaugggcaacggagccggccggagacgcuga

SEQ ID NO: 30270 - RNA, 1614 nt, Artificial Sequence
  derived and/or modified sequence opt5 from VP1__Norovirus_and/or_Norovirus-like__AF472623
augaagauggccagcaacgacgcuaaucccuccgauggcucuaccgccaaccuggugccugaggucaauaacgaaguuauggcgcucgagccgguggugggggcugccaucgccgcucccgucgccggacagcaaaauauuaucgacccuuggauuagaaacaauuucgugcaggcucccggcggggaauuuacaguuagcccucggaacgcccccggagagauccugugguccgcgccucuuggcccggaucugaaucccuaccucucucaccuggcccgcauguauaacggguacgcuggaggcuucgaagugcaggucauucuugccggcaaugcuuuuacggccgggaaaaucaucuucgcggccgugccucccaacuuuccuaccgagggacugagccccucccagguuacaauguucccgcauauuaucguggacgucagacaacucgagccugugcugauuccccugccugaugugcggaauaacuuuuaucacuacaaucagucuaacgacagcaccaucaagcucauugcuaugcuguauacaccccuucgcgccaacaaugcuggcgaugacgucuucaccguuuccugcagagugcugacacggcccagcccugauuuugacuucaucuuucucgugccgcccaccgucgaaucucgcacgaaaccuuucaccgugcccauucugacaguugaggaaauguccaacagcagauuuccuaucccccuugagaagcuguacaccgggccgucuuccgccuucgugguccagccucagaauggacgguguacaaccgauggcgugcuccuggggacgacacaacugagcgccguuaacaucugcaccuuccgcggagacgugacacauauugcuggcucucacgauuauaccaugaaucucgcgucccagaacuggaauaacuacgaccccaccgaggaaaucccugcuccccugggcacaccugacuuugucgggaaaauucagggaaugcuuacgcagaccacaagagaggauggcagcacccgggcccauaaggccacaguguccaccgggucuguccacuucacgcccaagcugggaagcgugcaauacacaaccgacaccaauaacgauuuucagacaggccagaauaccaaauucacaccgguuggggugauccaagacggaaacaaucaccagaacgaaccucagcaguggguccuccccaauuauuccggccgcacgggccauaacgugcaccuggcccccgcuguugccccuaccuuuccgggggagcaacuucuguucuuuagaagcacaaugcccggauguucuggcuacccuaacaugaaucucgauugccugcugccccaggaaugggugcagcauuucuaucaggaggcggcuccugcccaauccgacgucgcccuccugcgguuugugaaccccgauaccgggcgcgugcuuuucgaguguaagcugcacaaaagcggauacguuacagucgcucacaccggcccucaugaccucgugauucccccgaauggguauuuuagauucgauucuugggugaaccaguuuuacacgcuggccccuaugggcaauggagcuggccggagacgcuga

SEQ ID NO: 30271 - RNA, 1614 nt, Artificial Sequence
  derived and/or modified sequence opt5 from VP1__Norovirus_and/or_Norovirus-like__AF427114
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccgccuccugcagagugcugacacggcccagcccugauuuugacuucauuuuucucgugccgcccaccgucgaaucucgcacgaaaccuuucaccgugcccauccugacaguugaggaaauguccaacagcagauuuccuauuccccuugagaagcuguacaccgggccgucuuccgccuucgugguccagccucagaauggacgguguacaaccgauggcgugcuccuggggacgacacaacugagcgcuguuaacaucugcaccuuccgcggagacgugacacauaucgcgggcucucacgauuauaccaugaaucucgccucccagaacuggaauaacuacgaccccaccgaggaaauuccugcuccccugggcacaccugacuuugucgggaaaauccagggagugcuuacgcagaccacaagagaggauggcagcacccgggcccauaaggccacagucuccaccgggucugugcacuucacgcccaagcugggaagcguucaauacacaaccgacaccaauaacgauuuucagacaggccagaauaccaaauucacaccggugggggucauucaagacggauccaaccaccagaaugaaccucagcagugggugcuccccaacuauagcggccgcacgggccauaauguucaccuggcucccgccguggcgccuaccuuuccgggggagcaacuucuguucuuuagaucuacaaugcccggauguuccggcuacccuaacaugaaccucgauugccugcugccccaggaauggguccagcauuucuaucaggaggcugccccugcccaaagcgacguggcucuccugcgguuugugaaucccgauaccgggcgcguucuuuucgaguguaagcugcacaaaucuggauacgucacaguggcccacaccggcccucaugaccucgugauucccccgaacggguauuuuagauucgauagcugggucaaucaguuuuacacgcuggcuccuaugggcaacggagccggccggagacgcuga

SEQ ID NO: 30272 - RNA, 1614 nt, Artificial Sequence
  derived and/or modified sequence opt5 from VP1__Norovirus_and/or_Norovirus-like__AY532114
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauaucgcuggcucucacgauuauaccaugaaucucgcgucccagaacuggaauaacuacgaccccaccgaggaaauuccugcuccccugggcacaccugacuuuguggggaaaauccagggaaugcuuacgcagaccacaagagaggauggcagcacccgggcccauaaggccacagucuccaccgggucugugcacuucacgcccaagcugggaagcguucaauacacaaccgacaccaauaacgauuuucagacaggccagaauaccaaauucacaccggugggggucauucaagacggaaacaaucaccagaacgaaccucaucagugggugcuccccaauuauuccggccgcacgggccacaacguucaucuggcccccgcuguggccccuaccuuuccgggggagcagcuucuguucuuuagaagcacaaugcccggauguucuggcuacccuaacaugaaucucgauugccugcugccccaagaauggguccagcacuucuaucaggaggcggcuccugcccaguccgacguggcccuccugcgguuugugaaccccgauaccgggcgcguucuuuucgaguguaagcugcacaaaagcggauacgucacaguggcucauaccggcccucacgaccucgugauucccccgaauggguauuuuagauucgauucuugggucaaccaauuuuacacgcuggccccuaugggcaauggagcuggccggagacgcuga

SEQ ID NO: 30273 - RNA, 1614 nt, Artificial Sequence
  derived and/or modified sequence opt5 from VP1__Norovirus_and/or_Norovirus-like__KF806505
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuggagccuucgugguucagccccagaauggccgguguaccacagacggggugcuccugggaaccacgcaacuguccccugucaacauuugcacauuucgcggcgaucucacccauuucacaggcaccagcgaauacgcuaugaaucuggcgucucagaacuggaauaacuaugaccccaccgaggaaaucccugcuccccuuggggccccggauuuugugggaaagaucagaggcaugcugacacagacgacccggcgcgacggguccacaagaggacaccgggccacccucagcacaggcuccgcccauuucaccccuaagcuggggucuauucgcuuuagcacggacacaaauaacgauuucgaggcuggacagaauaccaaauuuacccccgucggcguguuccaagaaggcgacaaccaccagaaugagccccagcaauggguucuuccuaacuacuccggggccacagcgcacaaugugcaucuggcuccggccgucgcccccgcuuuuccuggagagcagcuccuguucuuuagaagcaccaugcccggcugugggggauacccuaacaugaaucuggauugccuccugccccaggaaugggugcagcacuucuaucaagaggccgcuccugcccagucugacguugcgcuucugcgguuugugaaccccgauacauccagaguccucuucgaauguaagcugcauaaaagcggcuacgugacgguggcccacaccgggcagcacgaccuuguuaucccgccuaacggcuauuuccgcuuugauucuugggucaaucaguucuacacacuggcucccaugggaaacggcaccgggcggagacgcuga

SEQ ID NO: 30274 - RNA, 1614 nt, Artificial Sequence
  derived and/or modified sequence opt5 from VP1__Norovirus_and/or_Norovirus-like__JQ478407
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugagcaauucuagauuuccuauuccccuugagaagcuguacaccgggccguccagcgccuucgucgugcagccucagaacggacgguguacaaccgauggcguucuccuggggacgacacaacugucugccgugaauaucugcaccuuccgcggagacaucacacauauugcuggcucccacgauuauaccaugaaccucgcgagccagaauugguccaacuacgaccccaccgaggaaaucccugcuccccugggcacaccugacuuugucgggaaaauucagggaaugcuuacgcagaccacaagagaggauggcucuacccgggcccauaaggccacagugagcaccggguccguccacuucacgcccaagcugggaagcgugcaauacacaaccgacaccaauaacgauuuucagacaggccagaauaccaaauucacaccgguuggggugauccaagacggaggcaaccaccagaaugaaccucagcaguggguccuccccaacuauucuggccgcacggggcauaaugugcaccuggcccccgcuguugccccuaccuuuccgggagagcaacuucuguucuuuagauccacaaugcccggcuguagcggguacccuaacaugaaucucgauugccugcugccccaggaaugggugcagcauuucuaucaggaggcggcuccugcccaaucugacgucgcccuccugcgguuugugaaccccgauaccggacgcgugcuuuucgaguguaagcugcacaaaagcggcuacguuacagucgcucacaccgggccucaugaccucgugauucccccgaacggcuauuuuagauucgauuccugggugaaucaguuuuacacgcuggccccuaugggaaacggcgcugggcggagacgcuga

SEQ ID NO: 30275 - RNA, 1614 nt, Artificial Sequence
  derived and/or modified sequence opt5 from VP1__Norovirus_and/or_Norovirus-like__AB303923
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauaucgcuggcucucacgauuauaccaugaaucucgcgucccagaacuggaauaacuacgaccccaccgaggaaauuccugcuccccugggcacaccugacuuuguggggaaaauccagggaaugcuuacgcagaccacaagagaggauggcagcacccgggcccauaaggccacagucuccaccgggucugugcacuucacgcccaagcugggaagcguucaauacacaaccgacaccaauaacgauuuucagacaggccagaauaccaaauucacaccggugggggucauucaagacggaaacaaucaccagaacgaaccucagcagugggugcuccccaauuauuccggccgcacgggccauaacguucaccuggcccccgcuguggccccuaccuuuccgggggagcaacuucuguucuuuagaagcacaaugcccggauguucuggcuacccuaacaugaaucucgauugccugcugccccaggaauggguccagcauuucuaucaggaggcggcuccugcccaauccgacguggcccuccugcgguuugugaaccccgauaccgggcgcguucuuuucgaguguaagcugcacaaaagcggauacgucacaguggcucacaccggcccucaugaccucgugauucccccgaauggguauuuuagauucgauucuugggucaaccaguuuuacacgcuggccccuaugggcaauggagcuggccggagacgcuga

SEQ ID NO: 30276 - RNA, 1614 nt, Artificial Sequence
  derived and/or modified sequence opt5 from VP1__Norovirus_and/or_Norovirus-like__AF427120
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucaucguccagccucagaauggacgguguacaaccgauggcgugcuccuggggacgacacaacugagcgccguuaacaucugcaccuuccgcggagacgugacacauauugcuggcucucacgauuauaccaugaaucucgcgucccagaacuggaauaacuacgaccccaccgaggaaaucccugcuccccugggcacaccugacuuugucgggaaaauucagggaaugcuuacgcagaccacaagagaggauggcagcacccgggcccauaaggccacaguguccaccgggucuguccacuucacgcccaagcugggaagcgugcaauacacaaccgacaccaauaacgauuuucagacaggccagaauaccaaauucacaccgguuggggugauccaagacggaaacaaucaccagaacgaaccucagcaguggguccuccccaauuauuccggccgcacgggccauaacgugcaccuggcccccgcuguugccccuaccuuuccgggggagcaacuucuguucuuuagaagcacaaugcccggauguucuggcuacccuaacaugaaucucgauugccugcugccccaggaaugggugcagcauuucuaucaggaggcggcuccugcccaauccgacgucgcccuccugcgguuugugaaccccgauaccgggcgcgugcuuuucgaguguaagcugcacaaaagcggauacguuacagucgcucacaccggcccucaugaccucgugauucccccgaauggguauuuuagauucgauucuugggugaaccaguuuuacacgcuggccccuaugggcaauggagcuggccggagacgcuga

SEQ ID NO: 30277 - RNA, 1614 nt, Artificial Sequence
  derived and/or modified sequence opt5 from VP1__Norovirus_and/or_Norovirus-like__AY532134
augaagauggccagcaacgacgcuaaucccuccgauggcucuaccgccaaccuggugccugaggucaauaacgaaguuauggcgcucgagccgguggugggggcugccaucgccgcucccgucgccggacagcaaaauaucaucgacccuuggauuagaaacaauuucgugcaggcucccggcggggaauuuacaguuagcccucggaacgcccccggagagauccugugguccgcgccucuuggcccggaucugaaucccuaccucucucaccuggcccgcauguauaacggguacgcuggaggcuucgaagugcaggucauucuugccggcaaugcuuuuacggccgggaaaaucaucuucgcggccgugccucccaacuuuccuaccgagggacugagccccucccagguuacaauguucccgcauauuaucguggacgucagacaacucgagccugugcugauuccccugccugaugugcggaauaacuuuuaucacuacaaucagucuaacgacagcaccaucaagcucauugcuaugcuguauacaccccuucgcgccaacaaugcuggcgaugacgucuucaccguuuccugcagagugcugacacggcccagcccugauuuugacuucaucuuucucgugccgcccaccgucgaaucucgcauuaaaccuuucacggugcccauccugaccguugaggaaauguccaacagcagauuuccuaucccccuugagaagcuguacacagggccgucuuccgccuucgugguccagccucagaauggacgguguaccacagauggcgugcuccuggggaccacgcaacugagcgccguuaacauuugcacauuccgcggagacgugacccauaucgcuggcucucacgauuauacaaugaaucucgcgucccagaacuggaauaacuacgaccccaccgaggaaauuccugcuccccugggcaccccugacuuugucgggaaaauccagggagugcuuacacagacgaccagagaggauggcagcacacgggcccauaaggccaccgucuccacagggucugugcacuucacccccaagcugggaagcguucaauacacgacagacaccaauaacgauuuucagaccggccagaauacaaaauucaccccggugggggucauucaagacggaaacaaucaccagaacgaaccucagcagugggugcuccccaauuauuccggccgcgccggccauaacguucaccuggcucccgccguggcgccuacauuuccgggggagcaacuucuguucuuuagaagcacgaugcccggauguucuggcuacccuaacaugaaucucgauugccugcugccccaggaauggguccagcauuucuaucaggaggcugccccugcccaauccgacguggcucuccugcgguuugugaaccccgauaccgggcgcguucuuuucgaguguaagcugcacaaaagcggauacgucacaguggcccacaccggcccucaugaccucgugauucccccgaauggguauuuuagauucgauucuugggucaaccaguuuuacgcucuggccccuaugggcaauggagcgggccggagacgcuga

SEQ ID NO: 30278 - RNA, 1614 nt, Artificial Sequence
  derived and/or modified sequence opt5 from VP1__Norovirus_and/or_Norovirus-like__AY532116
augaagauggccagcaacgacgcuaaucccuccgauggcucuaccgccaaccuggugccugaggucaauaacgaaguuauggcgcucgagccgguggugggggcugccaucgccacacccgucgcuggacagcaaaaugugaucgacccuuggaucagaaacaauuucguucaggcccccggcggggaauuuacggugagcccucggaacgcucccggagagauucugugguccgccccucuuggcccggaucugaaucccuaccucucucaccuggcgcgcauguauaacggguacgccggaggcuucgaaguccaggugauccuugcuggcaaugccuuuaccgcugggaaaauuaucuucgccgcgguuccucccaacuuuccuacagagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacgguggaaucucgcaccaaaccuuucacaguucccauccugaccguggaggaaauguccaacagcagauuuccuauuccccuugagaagcuguacacagggccgucuuccgcuuucgucgugcagccucagaauggacgguguaccacggauggcguucuccuggggacaacccaacugagcgccgugaacaucugcacauuccgcggagacgucacccauaucgccggcucucacgauuauaccaugaaucucgcuucccagaacuggaauaacuacgaccccacagaggaaauuccugcgccccugggcacgccugacuuuguggggaaaauccagggaaugcuuacccagacaaccagagaggauggcagcacacgggcccauaaggcuaccgucuccacggggucugugcacuucacacccaagcugggaagcguucaauacaccaccgacacaaauaacgauuuucagaccggccagaauacaaaauucacgccggugggggucauucaagacggaaacaaucaccagaacgaaccucagcagugggugcuccccaauuauuccggccgcaccggccauaacguucaccuggcccccgccguggcuccuacauuuccgggggagcaacuucuguucuuuagaagcaccaugcccggauguucuggcuacccuaacaugaaucucgauugccugcugccccaggaauggguccagcauuucuaucaggaggccgcgccugcucaauccgacguggcccuccugcgguuugugaaccccgauacagggcgcguucuuuucgaguguaagcugcacaaaagcggauacgucaccguggcccacacgggcccucaugaccucgugauucccccgaauggguauuuuagauucgauucuugggucaaccaguuuuacacccuggcuccuaugggcaauggagccggccggagacgcuga

SEQ ID NO: 30279 - RNA, 1614 nt, Artificial Sequence
  derived and/or modified sequence opt5 from VP1__Norovirus_and/or_Norovirus-like__AY532112
augaagauggccagcaacgacgcuaaucccuccgauggcucuaccgccaaccuggugccugaggucaauaacgaaguuauggcgcucgagccgguggugggggcugccaucgccgcucccgucgccggacagcaaaauauuaucgacccuuggauuagaaacaauuucgugcaggcucccggcggggaauuuacaguuagcccucggaacgcccccggagagauccugugguccgcgccucuuggcccggaucugaaucccuaccucucucaccuggcccgcauguauaacggguacgcuggaggcuucgaagugcaggucauucuugccggcaaugcuuuuacggccgggaaaaucaucuucgcggccgugccucccaacuuuccuaccgagggacugagccccucccagguuacaauguucccgcauauuaucguggacgucagacaacucgagccugugcugauuccccugccugaugugcggaauaacuuuuaucacuacaaucagucuaacgacagcaccaucaagcucauugcuaugcuguauacaccccuucgcgccaacaaugcuggcgaugacgucuucaccguuuccugcagagugcugacacggcccagcccugauuuugacuucaucuuucucgugccgcccaccgucgaaucucgcacgaaaccuuucaccgcccccauucugacaguggaggaaauguccaacagcagauuuccuaucccccuugagaagcuguacaccgggccgucuuccgccuucguugugcagccucagaauggacgguguacaaccgauggcguccuccuggggacgacacaacugagcgcugugaacaucugcaccuuccgcggagacguuacacauauugcgggcucucacgauuauaccaugaaucucgccucccagaacuggaauaacuacgaccccaccgaggaaaucccugcuccccugggcacaccugacuuuguggggaaaauucagggaaugcuuacgcagaccacaagagaggauggcagcacccgggcccauaaggccacagucuccaccgggucugugcacuucacgcccaagcugggaagcguccaauacacaaccgacaccaauaacgauuuucagacaggccagaauaccaaauucacaccgguggggguuauccaagacggaaacaaucaccagaacgaaccucagcagugggugcuccccaauuauuccggccgcacgggccauaacguccaccuggcucccgccguggcgccuaccuuuccgggggagcaacuucuguucuuuagaagcacaaugcccggauguucuggcuacccuaacaugaaucucgauugccugcugccccaggaauggguucagcauuucuaucaggaggcugccccugcccaauccgacguggcucuccugcgguuugucaaccccgauaccgggcgcgugcuuuucgaguguaagcugcacaaaagcggauacgugacaguugcccacaccggcccucaugaccucgucauucccccgaauggguauuuuagauucgauucuugggugaaccaguuuuacacgcuggcuccuaugggcaauggagccggccggagacgcuga

SEQ ID NO: 30280 - RNA, 1614 nt, Artificial Sequence
  derived and/or modified sequence opt5 from VP1__Norovirus_and/or_Norovirus-like__KX514275
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccauccugacggugggggagaugaccaacagcagauuuccuauuaaucuugaacggcuguucacaggacccucuuccgccaacgucgugcagccgcagaauggccgcuguaccaucgauggggagcuccugggaacaacccaacugagcucuguuaacaucugcacguucagaggcgacgugacacauauuggcuccacccaccauuggacaaugaaucucgcuagcccuaacuggaauaacuacgaucccaccgaggaaaccccugcgccccuggggacaccugacuuugucggaaagauccacggcaugcuuacgcagaccacacaggagaauggguccacccgggcccaccgcgcuacaguguaugucggaucugccgacuucacccccaaacugggcaaggugcaguuugaaacggauacagaggacgaucucgccauuagacaaaacaccaaguucaccccgguuggggugauccagagcuccgaccaucaccgggaugaaccucagcaauggcgccugcccaauuacagcggagcuaacacauuuaauguccaucuugcccccgcgguggcuccuaacuucccgggcgagcagcugcucuuuuucagaucuacccugcccggcugugggggacacccuaacauggaccuggauugccuccugccccaggaguggguucagcacuuuuaccaagaagccgccccugcucaguccgacguggcccuucugcgguucgucaaucccgauacaagcagagugcucuuugaguguaaacugcauaagucuggcuaugugacgguugcucacaccgggcaguacgaccuuguccugccuagcaacggauauuuccgcuuugauuccugggugaaucaguucuacacacucgcccccaugggcaacgggaccggccggagacgcuga

SEQ ID NO: 30281 - RNA, 1614 nt, Artificial Sequence
  derived and/or modified sequence opt5 from VP1__Norovirus_and/or_Norovirus-like__KF806510
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuggagccuucgugguucagccccagaauggccgguguaccacagacggggugcuccugggaaccacgcaacuguccccugucaacauuugcacauuucgcggcgaucucacccauuucacaggcaccagcgaauacgcuaugaaucuggcgucucagaacuggaauaacuaugaccccaccgaggaaaucccugcuccccuuggggccccggauuuugugggaaagaucagaggcaugcugacacagacgacccggcgcgacggguccacaagaggacaccgggccacccucagcacaggcuccgcccauuucaccccuaagcuggggaauauucgcuuuucuacggacacaaacaaugauuucgaggcuggacagaacaccaaauuuacccccgucggcguguuccaagaaggcgacaaucaccagaacgagccccagcaauggguucuuccuaauuacagcggggccacagcgcacaacgugcaucuggcuccggccgucgcccccgcuuuuccuggagagcagcuccuguucuuuagauccaccaugcccggcugugggggauacccuaauaugaaccuggauugccuccugccccaggaaugggugcagcacuucuaucaagaggccgcuccugcccagagcgacguugcgcuucugcgguuugugaaccccgauacaucuagaguccucuucgaauguaagcugcauaaauccggcuacgugacgguggcccacaccgggcagcacgaccuuguuaucccgccuaauggcuauuuccgcuuugauagcugggucaaccaguucuacacacuggcucccaugggaaauggcaccgggcggagacgcuga

SEQ ID NO: 30282 - RNA, 1614 nt, Artificial Sequence
  derived and/or modified sequence opt5 from VP1__Norovirus_and/or_Norovirus-like__EU078410
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccagacgauccuugccggcaacgcuuuuaccgccgggaaaauuaucuucgcggccgugccucccaauuuuccuacagagggacugucccccucucagguuaccauguucccgcauaucauuguggacgucagacaacucgagccugugcugaucccccugccugaugugcggaacaauuuuuaucacuacaaccagagcaaugaccccacaauuaagcucaucgcuaugcuguauacaccccuucgcgccaacaacgcuggcgaugacgucuucaccguuuccugcagagugcugacccggccuagcccggauuuugacuucauuuuucucgugcccccuacggucgaaucucgcaccaaacccuucacagugccuauccugaccguugaggaaauguccaauagcagauuucccauuccgcuugagaagcuguacacagggccuucuuccgccuucgugguccagccccagaacggacgguguaccacggauggcgugcuccuggggacaacccaacugagcgccguuaauaucugcacauuccgcggagacgugacccauaucgcuggcucucacgauuauaccaugaaccucgcgucccagaauuggaacaauuacgacccuacagaggaaauucccgccccucugggcacgcccgacuuugucgggaaaauccagggaaugcuuacccagacaaccagagaggauggcagcacacgggcucauaaggccaccguguccacggggucuguccacuucacaccgaagcugggaagcgugcaauacaccaccgacacaaacaaugauuuucaggccggccagaacaccaaauucacaccuguuggggugauucaagacggaaauaaccaccagaaugaaccccagcaguggguccuccccaacuauuccggccgcacgggccauaaugugcaccuggcuccugccguugcgccgaccuuucccggggagcaacuucuguucuuuagaagcacaaugccuggauguucuggcuaccccaacaugaaccucgauugccugcugccucaggaaugggugcagcauuucuaucaggaggcugcccccgcccaauccgacgucgcucuccugcgguuugugaauccugauaccgggcgcgugcuuuucgaguguaagcugcacaaaagcggauacguuacagucgcccacaccggcccccaugaccucgugaucccgccuaacggguauuuuagauucgauucuugggugaaucaguuuuacacgcuggcucccaugggcaacggaaccggccggagacgcuga

SEQ ID NO: 30283 - RNA, 1614 nt, Artificial Sequence
  derived and/or modified sequence opt5 from VP1__Norovirus_and/or_Norovirus-like__AF427123
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauaucgcuggcucucacgauuauaccaugaaucucgcgucccagaacuggaauaacuacgaccccaccgaggaaauuccugcuccccugggcacaccugacuuuguggggaaaauccagggaguccuuacgcagaccacaagagaggauggcagcacccgggcccauaaggccacaguguccaccgggucuguucacuucacgcccaagcugggaagcgugcaauacacaaccgacaccaauaacaauuuucagacaggccagaacaccaaauucacaccggucggggugauucaagauggaaauaaccaccagaaugaaccucagcaguggguucuccccaacuauuccggccgcacgggccauaacgugcaccuggcccccgcugucgccccuaccuuuccgggggagcaacuucuguucuuuagaagcacaaugcccggauguucuggcuacccuaauaugaaccucgacugccugcugccccaggaaugggugcagcauuucuaucaggaggcggcuccugcccaauccgauguggcccuccugcgguuuguuaaucccgacaccgggcgcguccuuuucgaguguaagcugcacaaaagcggauacgugacaguggcucacaccggcccucaugaucucgucauucccccgaacggguauuuuagauucgacucuugggugaaucaguuuuacacgcuggccccuaugggcaacggagcuggccggagacgcuga

SEQ ID NO: 30284 - RNA, 1614 nt, Artificial Sequence
  derived and/or modified sequence opt5 from VP1__Norovirus_and/or_Norovirus-like__AY532135
augaagauggccagcaacgacgcuaaucccccugauggcuccaccgccaaccuggugccggaggucaauaacgaaguuauggcgcucgagcccguggugggggcugccaucgccgcuccugucgccggacagcaaaauauuaucgaccccuggauuagaaacaauuucgugcaggcuccuggcggggaauuuacaguuucuccccggaacgccccuggagagauccuguggagcgcgccgcuuggccccgaucugaauccuuaccucucccaccuggcccgcauguauaacggguacgcuggaggcuucgaagugcaggucauucuugccggcaaugcuuuuacggccgggaaaaucaucuucgcggccgugcccccuaacuuucccaccgagggacugucuccgagccagguuacaauguucccucauauuaucguggacgucagacaacucgagcccgugcugauuccucugcccgaugugcggaauaacuuuuaucacuacaaucaguccaacgacucuaccaucaagcucauugcuaugcuguauacaccccuucgcgccaacaaugcuggcgaugacgucuucaccguuagcugcagagugcugacacggccuuccccggauuuugacuucaucuuucucgugcccccuaccgucgaaagccgcacgaaacccuucaccgugccuauucugacaguugaggaaaugucuaacuccagauuucccaucccgcuugagaagcuguacaccgggccuagcucugccuucgugguccagccccagaauggacgguguacaaccgauggcgugcuccuggggacgacacaacuguccgccguuaacaucugcaccuuccgcggagacgugacacauauugcuggcagccacgauuauaccaugaaucucgcgucucagaacuggaauaacuacgacccuaccgaggaaauccccgccccucugggcacacccgacuuugucgggaaaauucagggagugcuuacgcagaccacaagagaggauggcuccacccgggcucauaaggccacagucagcaccggguccgugcacuucacgccgaagcugggaucuguucaauacacaaccgacaccaauaacgauuuucagacaggccagaauaccaaauucacaccugugggggucauccaagacggaaacaaucaccagaacgaaccccagcagugggugcuccccaauuauagcggccgcacgggccauaacguucaccuggccccugcuguggccccgaccuuucccggggagcaacuucuguucuuuagauccacaaugccuggauguagcggcuaccccaacaugaaucucgauugccugcugccucaggaauggguccagcauuucuaucaggaggcggcucccgcccaaucugacguggcccuccugcgguuugugaacccugauaccgggcgcguucuuuucgaguguaagcugcacaaauccggauacgucacaguggcucacaccggcccccaugaccucgugauuccgccuaauggguauuuuagauucgauagcugggucaaccaguuuuacacgcuggcccccaugggcaauggagcuggccggagacgcuga

SEQ ID NO: 30285 - RNA, 1614 nt, Artificial Sequence
  derived and/or modified sequence opt5 from VP1__Norovirus_and/or_Norovirus-like__AY532125
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaguuauuuucgcggccgugccucccaacuuuccuaccgagggacugagccccucccaggucacaauguucccgcauaucaucguggacgugagacaacucgagccuguccugauuccccugccugauguucggaauaacuuuuaucacuacaaucagucuaacgacagcaccaucaagcucauugcuaugcuguauacaccccuucgcgccaacaaugcuggcgaugacguguucaccguguccugcagaguccugacacggcccagcccugauuuugacuucaucuuucucgugccgcccaccguugaaucucgcacgaaaccuuucaccgugcccauucugacagucgaggaaauguccaacagcagauuuccuaucccccuugagaagcuguacaccgggccgucuuccgccuucgugguucagccucagaauggacgguguacaaccgauggcgugcuccuggggacgacacaacugagcgccgucaacauuugcaccuuccgcggagacgugacacauaucgcuggcucucacgauuauaccaugaaucucgcgucccagaacuggaauaacuacgaccccaccgaggaaaucccugcuccccugggcacaccugacuuugucgggaaaauucagggaaugcuuacgcagaccacaagagaggauggcagcacccgggcccauaaggccacaguguccaccgggucuguucacuucacgcccaagcugggaagcgugcaauacacaaccgacaccaauaacgauuuucagacaggccagaauaccaaauucacaccggucggggugauccaagacggaaacaaucaccagaacgaaccucagcaguggguucuccccaauuauuccggccgcacgggccauaacgugcaccuggcccccgcugucgccccuaccuuuccgggggagcaacuucuguucuuuagaagcacaaugcccggauguucuggcuacccuaacaugaaucucgauugccugcugccccaggaaugggugcagcauuucuaucaggaggcggcuccugcccaauccgacguggcccuccugcgguuuguuaaccccgauaccgggcgcguccuuuucgaguguaagcugcacaaaagcggauacgugacaguggcucacaccggcccucaugaccucgucauucccccgaauggguauuuuagauucgauucuugggugaaccaguuuuacacgcuggccccuaugggcaauggagcuggccggagacgcuga

SEQ ID NO: 30286 - RNA, 1614 nt, Artificial Sequence
  derived and/or modified sequence opt5 from VP1__Norovirus_and/or_Norovirus-like__AJ277619
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaagcaacuucguucaggcucccggcggggaauuuacaguguccccucggaaugcccccggagagauucuguggucugcgccucuuggcccggaucugaaccccuaccucagccaccuggcccgcauguauaauggguacgcuggaggccuugaaguccaggugguucuggccggcaacgcuuucacggccgggaaaaucauuuuugcggccgugccucccaauuucccuaccgagggacucucccccucucaggucacaauguuuccgcauaucaucguggacgugagacaacuggagccuguccugauuccccucccugauguucggaacaauuucuaucacuacaaccagagcaaugacuccaccaucaagcugauugcuaugcuuuauacaccccugcgcgccaacgaugcuggcgacgauguguuuaccgugagcugcagaguccucacacggcccucuccugacuucgauuuuaucuuccuggugccgcccaccguugaaucccgcacgaaaccuuuuaccgugcccauucuuacagucgaggaaaugagcaacucuagauucccuaucccccuggagaagcucuacaccgggccguccagcgccuuugugguucagccucagaauggacgguguacaaccgacggcgugcugcuggggacgacacaacucucugccgucaacauuugcaccuuccgcggagaugugacacauaucgcuggcucccacgacuauaccaugaaucuggcgagccagaacuggaauaacuacgaccccaccgaggaaaucccugcuccccuuggcacaccugauuucgucgggaaaauucagggaaugcugucccagacgaccagaggcgacgauucuacacgggcccauaaggccaccgugagcacaggguccguucacuuuacccccaagcucggaagcgugcaauacacgacagacaccaauaacgauuucgagaccggccagaauacaaaauuuaccccggucggggugauccaggacggaaacaaucaccaaaacgaaccucagcaguggguucugcccaauuauucuggccgcacaggccauaacgugcaccuugcccccgcugucgccccuacguucccgggggagcagcugcucuuuuucagauccaccaugcccggauguagcggcuacccuaauaugaaccuggauugccugcucccccaagaaugggugcagcauuuuuaucaggaggcggcuccugcccagucugacguggcccugcuucgguucguuaaccccgauacagggcgcguccuguuugaguguaagcuccacaaaagcggauacgugaccguggcucacacaggcccucaugaccuggucauucccccgaauggguauuucagauuugauuccugggugaaccaacuuuacacccuggccccuaugggcaauggagcuggccggagacgcuga

SEQ ID NO: 30287 - RNA, 1614 nt, Artificial Sequence
  derived and/or modified sequence opt5 from VP1__Norovirus_and/or_Norovirus-like__AF080556
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauaucgcuggcucucacgauuauaccaugaaucucgcgucccagaacuggaauaacuacgaccccaccgaggaaauuccugcuccccugggcacaccugacuuuguggggaaaauccagggaaugcuuacgcagaccacaagagaggauggcagcacccgggcccauaaggccacagucuccaccgggucugugcacuucacgcccaagcugggaagcguucaauacacaaccgacaccaauaacgauuuucaggccggccagaauacaaaauucaccccggugggggucauucaagacggaaacaaucaccagaacgaaccucagcagugggugcuccccaauuauuccggccgcacaggccauaacguucaccuggcucccgccguggcgccuacguuuccgggggagcaacuucuguucuuuagaagcaccaugcccggauguucuggcuacccuaacaugaaucucgauugccugcugccccaggaauggguccagcauuucuaucaggaggcugccccugcccaauccgacguggcucuccugcgguuugugaaccccgauacagggcgcguucuuuucgaguguaagcugcacaaaagcggauacgucaccguggcccacacaggcccucaugaccucgugauucccccgaauggguauuuuagauucgauucuugggucaaccaguuuuacacccuggcuccuaugggcaauggagccggccggagacgcuga

SEQ ID NO: 30288 - RNA, 1614 nt, Artificial Sequence
  derived and/or modified sequence opt5 from VP1__Norovirus_and/or_Norovirus-like__AF080550
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuagcgacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugagcaauucuagauuuccuauuccccuugagaagcuguacaccgggccguccagcgccuucgucgugcagccucagaacggacgguguacaaccgauggcguucuccuggggacgacacaacugucugccgugaauaucugcaccuuccgcggagacgucacacauaucgcuggcucccacgauuauaccaugaaccucgcgagccagaauuggaacaauuacgaccccaccgaggaaauuccugcuccccugggcacaccugacuuuguggggaaaauccagggaaugcuuacgcagaccacaagagaggauggcuccacccgggcccauaaggccacagucucuaccgggagcgugcacuucacgcccaagcugggauccguucaauacacaaccgacaccaacaaugauuuucagacaggccagaacaccaaauucacaccggugggggucauucaagacggaaauaaccaccagaaugaaccucagcagugggugcuccccaacuauagcggccgcacgggccauaauguucaccuggcccccgcuguggccccuaccuuuccgggggagcaacuucuguucuuuagaucuacaaugcccggauguuccggcuacccuaacaugaaccucgauugccugcugccccaggaauggguccagcauuucuaucaggaggcggcuccugcccaaagcgacguggcccuccugcgguuugugaaucccgauaccgggcgcguucuuuucgaguguaagcugcacaaaucuggauacgucacaguggcucacaccggcccucaugaccucgugauucccccgaacggguauuuuagauucgauagcugggucaaucaguuuuacacgcuggccccuaugggcaacggagcuggccggagacgcuga

SEQ ID NO: 30289 - RNA, 1614 nt, Artificial Sequence
  derived and/or modified sequence opt5 from VP1__Norovirus_and/or_Norovirus-like__EU078407
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauaucgcuggcucucacgauuauaccaugaaucucgcgucccagaacuggaauaacuacgaccccaccgaggaaauuccugcuccccugggcacaccugacuuuguggggaaaauccagggaaugcuuacgcagaccacaagaggcgaugggagcacccgggcccauaaggccacagucuccaccggaucugugcacuucacgcccaagcugggcagcguucaauuuacaaccgacaccaauaacgauuuccagacagggcagaauaccaaauuuacaccggugggagucauucaagacggcgauaaccaccagaaugagccucagcagugggugcuccccaacuacuccggccgcacggggcauaauguucaccuggcccccgcuguggccccuaccuucccgggagaacaacuucuguuuuucagaagcacaaugcccggcuguucuggguauccuaacaugaaccucgacugccugcugccccaggaguggguccagcauuuuuaccaggaagcggcuccugcccaauccgauguggcccuccugcgguucgugaaucccgacaccggacgcguucuuuuugaguguaagcugcacaaaagcggcuaugucacaguggcucacaccgggccucaugaucucgugauucccccgaacggcuacuucagauuugacucuugggucaaucaguucuauacgcuggccccuaugggaaacggcaccgggcggagacgcuga

SEQ ID NO: 30290 - RNA, 1614 nt, Artificial Sequence
  derived and/or modified sequence opt5 from VP1__Norovirus_and/or_Norovirus-like__AB083781
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaagcaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugagcaauucuagauuuccuauuccccuugagaagcuguacaccgggccguccagcgccuucgucgugcagccucagaacggacgguguacaaccgauggcguucuccuggggacgacacaacugucugccgugaauaucugcacccuccgcggagacgucacacauaucgcuggcucccacgauuauaccaugaaccuggcgagccagaauuggaacaauuacgaccccaccgaggaaauuccugcuccccuuggcacaccugacuucguggggaaaauccagggaaugcugucccagacgaccagaggcgaugggucuacacgggcccauaaggccaccgucagcacaggauccgugcacuuuacccccaagcucggcagcguucaauacacgacagacaccaacaaugauuucgagaccgggcagaacacaaaauuuaccccggugggagucauucaggacggcaauaaccaccaaaaugaaccucagcagugggugcugcccaacuauucuggccgcacagggcauaauguucaccuugcccccgcuguggccccuacguucccgggagagcagcugcucuuuuucagauccaccaugcccggcuguagcggguacccuaacaugaaccuggauugccugcucccccaagaauggguccagcauuuuuaucaggaggcggcuccugcccagucugacguggcccugcuucgguucgugaaucccgauacaggacgcguucuguuugaguguaagcuccacaaaagcggcuacgucaccguggcucacacagggccucaugaccuggugauucccccgaacggcuauuucagauuugauuccugggucaaucaauucuacacccuugccccuaugggaaacggcgcugggcggagacgcuga

SEQ ID NO: 30291 - RNA, 1614 nt, Artificial Sequence
  derived and/or modified sequence opt5 from VP1__Norovirus_and/or_Norovirus-like__AF427122
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacgccugagcgccgugaacaucugcaccuucagaggagacgucacacauaucgcuggcucucgggauuauaccaugaaucucgcgucccaaaacuggaauaacuacgaccccaccgaggaaauuccugcuccccugggcacaccugacuuuguggggaaaauccagggaguccuuacgcagaccacacgcgaggauggcagcaccagagcccacaaggccacaguguccaccgggucuguucauuucacgcccaagcugggaagcgugcaguacacaaccgacaccaauaacgauuuucaaacaggccagaauaccaaauucacaccggucggggugauucaggacggaaacaaucaccaaaacgaaccucagcaguggguucuccccaauuauuccggccggacgggccacaacgugcaucuggcccccgcugucgccccuaccuuuccgggggagcagcuucuguucuuucgcagcacaaugcccggauguucuggcuacccuaacaugaaucucgauugccugcugccccaagaaugggugcagcacuucuaucaggaggcggcuccugcccaguccgacguggcccuccugagauuuguuaaccccgauaccgggcggguccuuuucgaguguaagcugcauaaaagcggauacgugacaguggcucacaccggcccucacgaccucgucauucccccgaauggguauuuuagauucgauucuugggugaaccaauuuuacacgcuggccccuaugggcaauggaguuggccgccggagauga

SEQ ID NO: 30292 - RNA, 1614 nt, Artificial Sequence
  derived and/or modified sequence opt5 from VP1__Norovirus_and/or_Norovirus-like__AY532133
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuucuccggaucugaaucccuaccucagccaccuggcccgcauguauaacggcuacgcugggggauucgaaguccaggugauccuugccggcaaugcuuuuacggccggcaaaauuaucuucgcggccguuccucccaacuuuccuaccgaggggcugucccccucucaggugacaauguucccgcauaucauugucgacgugagacaacucgagccugugcugaucccccugccugauguccggaauaacuuuuaucacuacaaucagagcaacgacuccaccauuaagcucaucgcuaugcuguauacaccccuucgcgccaacaaugcuggagaugacguuuucaccgugagcugcagagugcugacacggcccucuccugauuuugacuucauuuuucucgucccgcccaccguggaaucccgcaucaaaccuuucacgguucccauucugaccguggaggaaaugagcaacucuagauuuccuaucccccuugagaagcuguacacaggcccguccagcgccuucgucgugcagccucagaaugggcgguguaccacagauggaguucuccugggcaccacgcaacugucugccgugaacaucugcacauuccgcggggacgucacccauauugcuggaucccacgauuauacaaugaaucucgcgagccagaacuggaauaacuacgaccccaccgaggaaaucccugcuccccugggcaccccugacuuugugggcaaaauucaggggaugcuuacacagacgaccagagaggauggauccacacgggcccauaaggccaccgucucuacaggcagcgugcacuucacccccaagcugggguccguucaauacacgacagacaccaauaacgauuuucagaccggacagaauacaaaauucaccccggugggcgucauccaagacgggaacaaucaccagaacgaaccucagcagugggugcuccccaauuauagcggacgcacaggccauaacguucaccuggcccccgcuguggccccuacguuuccgggcgagcaacuucuguucuuuagaucuaccaugcccggguguuccggauacccuaacaugaaucucgauugccugcugccccaggaauggguccagcauuucuaucaggaggcggcuccugcccaaagcgacguggcccuccugcgguuugugaaccccgauacaggccgcguucuuuucgaguguaagcugcacaaaucuggguacgucaccguggcucacacaggaccucaugaccucgugauucccccgaauggcuauuuuagauucgauagcugggucaaccaguuuuacacccuggccccuauggggaauggcgcuggacggagacgcuga

SEQ ID NO: 30293 - RNA, 1614 nt, Artificial Sequence
  derived and/or modified sequence opt5 from VP1__Norovirus_and/or_Norovirus-like__AY532131
augaagauggccagcaacgacgcuaaucccuccgauggcucuaccgccaaccuggugccugaggucaauaacgaaguuauggcgcucgagccgguggugggggcugccaucgccgcucccgucgccggacagcaaaauauuaucgacccuuggauuagaaacaauuucgugcaggcucccggcggggaauuuacaguuagcccucggaacgcccccggagagauccugugguccgcgccucuuggcccggaucugaaucccuaccucucucaccuggcccgcguguauaacggguacgcuggaggcuucgaaguccaggugauucuugccggcaaugcuuuuacggccgggaaaaucaucuucgcggccguuccucccaacuuuccuaccgagggacugagccccucccaggugacaauguucccgcauauuaucgucgacgugagacaacucgagccugugcugauuccccugccugauguccggaauaacuuuuaucacuacaaucagucuaacgacagcaccaucaagcucauugcuaugcuguauacaccccuucgcgccaacaaugcuggcgaugacguuuucaccguguccugcagagugcugacacggcccagcccugauuuugacuucaucuuucucgucccgcccaccguggaaucucgcacgaaaccuuucaccguucccauucugacaguggaggaaauguccaacagcagauuuccuaucccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauauugcuggcucucacgauuauaccaugaaucucgcgucccagaacuggaauaacuacgaccccaccgaggaaaucccugcuccccugggcacaccugacuuuguggggaaaauucagggaaugcuuacgcagaccacaagagaggauggcagcacccgggcccauaaggccacagucuccaccgggucugugcacuucacgcccaagcugggaagcguucaauacacaaccgacaccaauaacgauuuucagacaggccagaauaccaaauucacaccggugggggucauccaagacggaaacaaucaccagaacgaaccucagcagugggugcuccccuccuauagcggccgcacgggccauaauguucaccuggcccccgcuguggccccuaccuuuccgggggagcaacuucuguucuuuagaucuacaaugcccggauguuccggcuacccuaacaugaaccucgauugccugcugccccaggaauggguccagcauuucuaucaggaggcggcuccugcccaaagcgacguggcccuccugcgguuugugaaucccgauaccgggcgcguucuuuucgaguguaagcugcacaaaucuggauacgucacaguggcucacaccggcccucaugaccucgugauucccccgaacggguauuuuagauucgauagcugggucaaucaguuuuacacgcuggccccuaugggcaacggagcuggccggagacgcuga

SEQ ID NO: 30294 - RNA, 1614 nt, Artificial Sequence
  derived and/or modified sequence opt5 from VP1__Norovirus_and/or_Norovirus-like__AY532121
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaguuauuuucgcggccgugccucccaacuuuccuaccgagggacugagccccucccaggucacaauguucccgcauaucaucguggacgugagacaacucgagccuguccugauuccccugccugauguucggaauaacuuuuaucacuacaaucagucuaacgacagcaccaucaagcucauugcuaugcuguauacaccccuucgcgccaacaaugcuggcgaugacguguucaccguguccugcagaguccugacacggcccagcccugauuuugacuucaucuuucucgugccgcccaccguugaaucucgcacgaaaccuuucaccgugcccauucugacagucgaggaaauguccaacagcagauuuccuaucccccuugagaagcuguacaccgggccgucuuccgccuucgugguucagccucagaauggacgguguacaaccgauggcgugcuccuggggacgacacaacugagcgccgucaacauuugcaccuuccgcggagacgugacacauaucgcuggcucucacgauuauaccaugaaucucgcgucccagaacuggaauaacuacgaccccaccgaggaaaucccugcuccccugggcacaccugacuuugucgggaaaauucagggaacgcuuacccagacaaccagagaggauggcagcacacgggcccauaaggccaccguguccacggggucuguucacuucacacccaagcugggaagcgugcaauacaccaccgacacaaauaacgauuuucagaccggccagaauacaaaauucacgccggucggggugauccaagacggaaacaaucaccagaacgaaccucagcaguggguucuccccaauuauuccggccgcaccggccauaacgugcaccuggcccccgcugucgccccuacauuuccgggggagcaacuucuguucuuuagaagcaccaugcccggauguucuggcuacccuaacaugaaucucgauugccugcugccccaggaaugggugcagcauuucuaucaggaggcggcuccugcccaauccgacguggcccuccugcgguuuguuaaccccgauacagggcgcguccuuuucgaguguaagcugcacaaaagcggauacgugaccguggcucacacgggcccucaugaccucgucauucccccgaauggguauuuuagauucgauucuuggaucaaccaguuuuacacccuggccccuaugggcaauggagcuggccggagacgcuga

SEQ ID NO: 30295 - RNA, 1614 nt, Artificial Sequence
  derived and/or modified sequence opt5 from VP1__Norovirus_and/or_Norovirus-like__AY532115
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgacguccaggugauccuugccggcaaugcuuuuacggccgggaaaauuaucuucgcggccguuccucccaacuuuccuaccgaaggacugagccccucccaggugacaauguucccgcauaucauugucgaugugagacaacucgagccugugcugaucccccugccugacguccggaauaacuuuuaucacuacaaucagucuaacgauagcaccauuaagcucaucgcuaugcuguauacaccccuucgcgccaacaaugcuggcgacgauguuuucaccguguccugcagagugcugacacggcccagcccugacuuugauuucauuuuucucgucccgcccaccguggagucucgcacgaaaccuuucaccguucccauccugacaguggaagagauguccaacagcagauuuccuauuccccuugaaaagcuguacaccgggccgucuuccgccuucgucgugcagccucagaauggacgguguacaaccgacggcguucuccuggggacgacacaacugagcgccgugaacaucugcaccuuccgcggagaugucacacauaucgcuggcucucacgacuauaccaugaaucucgcgucccagaacuggaauaacuacgaccccaccgaggagauuccugcuccccugggcacaccugauuuuguggggaaaauccagggaaugcuuacgcagaccacaagagaagacggcagcacccgggcccauaaggccacagucuccaccgggucugugcacuucacgcccaagcugggaagcguucaauacacaaccgauaccaauaacgacuuucagacaggccagaauaccaaauucacaccggugggggucauucaagauggaaacaaucaccagaacgagccucagcagugggugcuccccaauuauuccggccgcacgggccauaacguucaccuggcccccgcuguggccccuaccuuuccgggggaacaacuucuguucuuuagaagcacaaugcccggauguucuggcuacccuaacaugaaucucgacugccugcugccccaggaguggguccagcauuucuaucaggaagcggcuccugcccaauccgauguggcccuccugcgguuugugaaccccgacaccgggcgcguucuuuucgaguguaagcugcacaaaagcggauacgucacaguggcucacaccggcccucaugaucucgugauucccccgaauggguauuuuagauucgacucuugggucaaccaguuuuacacgcuggccccuaugggcaauggagcuggccggagacgcuga

SEQ ID NO: 30296 - RNA, 1614 nt, Artificial Sequence
  derived and/or modified sequence opt5 from VP1__Norovirus_and/or_Norovirus-like__KF806530
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuggagccuucgugguucagccccagaauggccgguguaccacagacggggugcuccugggaaccacgcaacuguccccugucaacauuugcacauuucgcggcgaucucacccauuucgcuggcacacacgaauacgcgaugaaucuggccagccagaacuggaauaacuaugaccccaccgaggaaaucccugcuccccuuggggccccggauuuugugggaaagaucagaggcguccugacccagacaacgcggcgcgacgggucuaccagaggacaucgggccacacucuccaccggcagcgcucacuucacaccuaagcugggguccauucgcuuuucuaccgacacgaauaacgauuucgaggccggacagaauacaaaauuuacccccgugggcguuuuccaagacggcgauaaccaccagaaugaaccccagcaaugggugcuuccuaacuacagcggggcgaccgcucauaauguccaccuggccccggccguggcucccgccuuuccuggagagcagcuccuguucuuuagauccacaaugcccggcuguagcggguacccuaacaugaaucuggacugccuccugccccaggaguggguucagcauuucuaucaagaagcugccccugcgcagucugauguggcccuucugcgguuugucaaccccgacaccuccagaguucucuucgaguguaagcugcacaaaagcggauacgugacaguggcucacacgggccagcaugaucuugucaucccgccuaacggguauuuccgcuuugacucuugggugaaucaguucuacacccuggcccccaugggcaacggaacaggccggagacgcuga

SEQ ID NO: 30297 - RNA, 1614 nt, Artificial Sequence
  derived and/or modified sequence opt5 from VP1__Norovirus_and/or_Norovirus-like__KF806513
augaagauggccagcaacgacgcuucccccucugauggcagcgccgcgaaucuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucgucguggacgugagacaacucgagccuguccugauuccccugccugauguucggaauaacuuuuaucacuacaaucaguccaaggaccccacaaucaaacucauugccaugcuguauacaccccuucgcgcuaacaaugccggcgaagauguguucaccgugagcugcagaguccugacccggccuucuccggacuuugauuucaucuuucucgugcccccuacaguugagucccgcagcaagcccuucaccgugccuauucugacggucgaagagaugaccaacucuagauuucccaucccgcuugagaaacuguucacagggccuuccggagccuucgugguucagccccagaacggccgguguaccacagacggggugcuccugggaaccacgcaacugagcccugucaauauuugcacauuucgcggcgaucucacccauuucacaggcaccucugaauacgcuaugaaccuggcgucccagaauuggaacaauuaugaccccaccgaggaaaucccugcuccccuuggggccccggauuuugugggaaagaucagaggcaugcugacacagacgacccggcgcgacgggagcacaagaggacaccgggccacccucuccacaggcucugcccauuucaccccuaagcuggggagcauucgcuuuuccacggacacaaacaaugauuucgaggcuagccagaacaccaaauuuacccccgucggaguguuccaagaaggcgacaaucaccagaacgagccccagcaauggguucuuccuaauuacucuggcgccacagcgcacaacgugcaucuggcuccggccgucgcccccgcuuuuccuggggagcagcuccuguucuuuagauccaccaugcccggauguggcggguacccuaauaugaaccuggauugccuccugccccaggaaugggugcagcacuucuaucaagaggccgcuccugcccagagcgacguugcgcuucugcgguuugugaaucccgauacaucuagaguccucuucgaauguaagcugcauaaaagcggauacgugacgguggcccacaccggccagcacgaccuuguuaucccgccuaacggguauuuccgcuuugauuccugggucaaccaguucuacacacuggcucccaugggcaauggaaccggccggagacgcuga

SEQ ID NO: 30298 - RNA, 1614 nt, Artificial Sequence
  derived and/or modified sequence opt5 from VP1__Norovirus_and/or_Norovirus-like__AY741811
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaguuauuuucgcggccgugccucccaacuuuccuaccgagggacugagccccucccaggucacaauguucccgcauaucaucguggacgugagacaacucgagccuguccugauuccccugccugauguucggaauaacuuuuaucacuacaaucagucuaacgacagcaccaucaagcucauugcuaugcuguauacaccccuuaaagccaacaaugcuggcgaugacguguucaccguguccugccgcguccugacaagacccagcccugauuuugacuucaucuuucucgugccgcccaccguugaaucucggacgaagccuuucaccgugcccauucugacagucgaggaaauguccaacagccgcuuuccuaucccccuugagaaacuguacaccgggccgucuuccgccuucgugguucagccucagaauggaagauguacaaccgauggcgugcuccuggggacgacacaacugagcgccgucaacauuugcaccuuccggggagacgugacacauaucgcuggcucucacgauuauaccaugaaucucgcgucccagaacuggaauaacuacgaccccaccgaggaaaucccugcuccccugggcacaccugacuuugucgggaagauucagggaaugcuuacgcagaccacacgcgaggauggcagcaccagagcccauaaggccacaguguccaccgggucuguucacuucacgcccaaacugggaagcgugcaauacacaaccgacaccaauaacgauuuucagacaggccagaauaccaaguucacaccggucggggugauccaagacggaaacaaucaccagaacgaaccucagcaguggguucuccccaauuauuccggccggacgggccauaacgugcaccuggcccccgcugucgccccuaccuuuccgggggagcaacuucuguucuuucgcagcacaaugcccggauguucuggcuacccuaacaugaaucucgauugccugcugccccaggaaugggugcagcauuucuaucaggaggcggcuccugcccaauccgacguggcccuccugagauuuguuaaccccgauaccgggcggguccuuuucgaguguaaacugcacaagagcggauacgugacaguggcucacaccggcccucaugaccucgucauucccccgaauggguauuuucgcuucgauucuugggugaaccaguuuuacacgcuggccccuaugggcaauggagcuggcagacggagauga

SEQ ID NO: 30299 - RNA, 1614 nt, Artificial Sequence
  derived and/or modified sequence opt5 from VP1__Norovirus_and/or_Norovirus-like__AY532122
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaguuauuuucgcggccgugccucccaacuuuccuaccgagggacugagccccucccaggucacaauguucccgcauaucaucguggacgugagacaacucgagccuguccugauuccccugccugauguucggaauaacuuuuaucacuacaaucagucuaacgacagcaccaucaagcucauugcuaugcuguauacaccccuucgcgccaacaaugcuggcgaugacguguucaccguguccugcagaguccugacacggcccagcccugauuuugacuucaucuuucucgugccgcccaccguugaaucucgcacgaaaccuuucaccgugcccauucugacagucgaggaaauguccaacagcagauuuccuaucccccuugagaagcuguacaccgggccgucuuccgccuucgugguucagccucagaauggacgguguacaaccgauggcgugcuccuggggacgacacaacugagcgccgucaacauuugcaccuucggaggcgacgugacacauaucgcuggcucucacgauuauaccaugaaucucgcgucccagaacuggaauaacuacgaccccaccgaggaaaucccugcuccccuggggacaccugacuuugucggaaaaauucagggcaugcuuacgcagaccacacgcgaggaugggagcaccagagcccauaaggccacaguguccaccggaucuguucacuucacgcccaagcugggcagcgugcaauacacaaccgacaccaauaacgauuuucagacagggcagaauaccaaauucacaccggucggagugauccaagacggcgauaaccaccagaaugaaccucagcaguggguucuccccaacuauuccggccggacggggcauaaugugcaccuggcccccgcugucgccccuaccuuuccgggagagcaacuucuguucuuucgcagcacaaugcccggcuguucuggguacccuaacaugaaccucgacugccugcugccccaggaaugggugcagcauuucuaucaggaggcggcuccugcccaauccgauguggcccuccugagauuuguuaaucccgacaccggacggguccuuuucgaguguaagcugcacaaaagcggcuacgugacaguggcucacaccgggccucaugaucucgucauucccccgaacggcuauuuucgcuucgacucuugggugaaucaguuuuacacgcuggccccuaugggaaacggcgcugggagacggagauga

SEQ ID NO: 30300 - RNA, 1614 nt, Artificial Sequence
  derived and/or modified sequence opt5 from VP1__Norovirus_and/or_Norovirus-like__AY532120
augaagauggccagcaacgacgcuaaucccuccgauggcucuaccgccaaccuggugccugaggucaauaacgaaguuauggcgcucgagccgguggugggggcugccaucgccgcucccgucgccggacagcaaaauauuaucgacccuuggauuagaaacaauuucgugcaggcucccggcggggaauuuacaguuagcccucggaacgcccccggagagauccugugguccgcgccucuuggcccggaucugaaucccuaccucucucaccuggcccgcauguauaacggguacgcuggaggcuucgaagugcaggucauucuugccggcaaugcuuuuacggccgggaaaaucaucuucgcggccgugccucccaacuuuccuaccgagggacugagccccucccagguuacaauguucccgcauauuaucguggacgucagacaacucgagccugugcugauuccccugccugaugugcgcaauucuuuuuaucacuacaaccagagcaaugacuccaccaucaagcucauugcuaugcuguauacaccccuucgggccaacaacgcuggcgaugacgucuucaccguuagcugcagagugcugacacggcccucuccugauuuugacuucaucuuucucgugccgcccaccgucgaaucccgcacgaaaccuuucaccgugcccauucugacaguugaggaaaugagcaauucuagauuuccuaucccccuugagaagcuguacaccgggccguccagcgccuucgugguccagccucagaacggacgguguacaaccgauggcgugcuccuggggacgacacaacugucugccguuaauaucugcaccuuccgcggagacgugacacauauugcuggcucccacgauuauaccaugaaccucgcgagccagaauuggaacaauuacgaccccaccgaggaaaucccugcuccccugggcacaccugacuuugucgggaaaauucagggaaugcuuacgcagaccacaagagaggauggcuccacccgggcccauaaggccacagugucuaccgggagcguccacuucacgcccaagcugggauccgugcaauacacaaccgacaccaacagcgauuuucagacaggccagaauaccaaauucacaccgguuggggugauccaagacggaaacaaucaccagaacgaaccucagcaguggguccuccccaauuauucuggcggcacggggcauaacgugcaccuggcccccgcuguugccccuaccuuuccgggagagcaacuucuguucuuucgcuccacaaugcccggcuguagcggguacccuaauaugaaccucgauugcuauucuccccaggaaugggugcagcauuucuaccaggaggcggcuccugcccaaagcgacgucgcccugcugagauuugugaaccccgauaccggacggguucucuucgaguguaagcugcacaaauccggcuaugugacagucgcucacaccgggccucaugaccuugugauucccccgaauggcuacuuucgcuucgauucuugggugaaccaguuuuauacgcuggccccuaugggaaauggcgcugggagacggagauga

SEQ ID NO: 30301 - RNA, 1614 nt, Artificial Sequence
  derived and/or modified sequence opt5 from VP1__Norovirus_and/or_Norovirus-like__AY532111
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuucuccggaucugaaucccuaccucagccaccuggcccgcauguauaacggcuacgcugggggauucgaaguccaggugauccuugccggcaaugcuuuuacggccggcaaaauuaucuucgcggccguuccucccaacuuuccuaccgaggggcugucccccucucaggugacaauguucccgcauaucauugucgacgugagacaacucgagccugugcugaucccccugccugauguccggaauaacuuuuaucacuacaaucagagcaacgacuccaccauuaagcucaucgcuaugcuguauacaccccuucgcgccaacaaugcuggagaugacguuuucaccgugagcugcagagugcugacacggcccucuccugauuuugacuucauuuuucucgucccgcccaccguggaaucccgcacgaaaccuuucaccguucccauccugacaguggaggaaaugagcaacucuagauuuccuauuccccuugagaagcuguacaccggcccguccagcgccuucgucgugcagccucagaaugggcgguguacaaccgauggaguucuccugggcacgacacaacugucugccgugaacaucugcaccuuccgcggggacgucacacauaucgcuggaucccacgauuauaccaugaaucucgcgagccagaacuggaauaacuacgaccccaccgaggaaauuccugcuccccugggcacaccugacuuugugggcaaaauccaggggaugcuuacgcagaccacaagagaggauggauccacccgggcccauaaggccacagucucuaccggcagcgugcacuucacgcccaagcugggguccguucaauacacaaccgacaccaauaacgauuuucagacaggacagaauaccaaauucacaccggugggcgucauucaagacgggaacaaucaccagaacgaaccucagcagugggugcuccccaauuauagcggacgcacgggccauaacguucaccuggcccccgcuguggccccuaccuuuccgggcgagcaacuucuguucuuuagaucuacaaugcccggguguuccggauacccuaacaugaaucucgauugccugcugccccaggaauggguccagcauuucuaucaggaggcggcuccugcccaaagcgacguggcccuccugcgguuugugaaccccgauaccggccgcguucuuuucgaguguaagcugcacaaaucuggguacgucacaguggcucacaccggaccucaugaccucgugauucccccgaauggcuauuuuagauucgauagcugggucaaccagguguacacgcuggccccuauggggaauggcgcuggacggagacgcuga

SEQ ID NO: 30302 - RNA, 1614 nt, Artificial Sequence
  derived and/or modified sequence opt5 from VP1__Norovirus_and/or_Norovirus-like__AF080558
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauaucgcuggcucucacgauuauaccaugaaucucgcgucccagaacuggaauaacuacgaccccaccgaggaaauuccugcuccccugggcacaccugacuuuguggggaaaauccagggaaugcuuacgcagaccacaagaggcgaugggagcacccgggcccauaaggccacagucuccaccggaucugugcacuucacgcccaagcugggcagcguucaauuuacaaccgacaccaauaacgauuuccagacagggcagaauaccaaauuuacaccggugggagucacgcaagacggcgauaaccaccagaaugagccucagcagugggugcuccccaacuacuccggccgcaccgggcauaauguucaccuggcccccgcuguggccccuacauucccgggagaacaacuucuguuuuucagaagcaccaugcccggcuguucuggguauccuaacaugaaccucgacugccugcugccccaggaguggguccagcauuuuuaccaggaagcggcuccugcccaauccgauguggcccuccugcgguucgugaaucccgacacaggacgcguucuuuuugaguguaagcugcacaaaagcggcuaugucaccguggcucacacggggccucaugaucucgugauucccccgaacggcuacuucagauuugacucuugggucaaucaguucuauacccuggccccuaugggaaacggcgcugggcggagacgcuga

SEQ ID NO: 30303 - RNA, 1614 nt, Artificial Sequence
  derived and/or modified sequence opt5 from VP1__Norovirus_and/or_Norovirus-like__KF806508
augaagauggccagcaacgacgcuucccccucugauggcagcgccgcgaaucuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucgucguggacgugagacaacucgagccuguccugauuccccugccugauguucggaauaacuuuuaucacuacaaucaguccaaggaccccacaaucaaacucauugccaugcuguauacaccccuucgcgcuaacaaugccggcgaagauguguucaccgugagcugcagaguccugacccggccuucuccggacuuugauuucaucuuucucgugcccccuacaguugagucccgcagcaagcccuucaccgugccuauucugacggucgaagagaugaccaacucuagauuucccaucccgcuugagaaacuguucacagggccuuccggagccuucgugguucagccccagaacggccgguguaccacagacggggugcuccugggaaccacgcaacugagcccugucaauauuugcacauuucgcggcgaucucacccauuucacaggcaccucugaauacgcuaugaaccuggcgucccagaauuggaacaauuaugaccccaccgaggaaaucccugcuccccuuggggccccggauuuugugggaaagaucagaggcaugcugacacagacgacccggcgcgacgggagcacaagaggacaccgggccacccucuccacaggcucugcccauuucaccccuaagcuggggagcauucgcuuuuccacggacacaaacaaugauuucgaggcuggacagaacaccaaauuuacccccgucggcaucuuccaagaaggcgacaaucaccagaacgagccccagcaaugggugcuuccuaauuacagcggggccacagcgcacaacguucaucuggcuccggccguggcccccgcuuuuccuggagagcagcuccuguucuuuagaucuaccaugcccggcugugggggauacccuaauaugaaccuggauugccuccugccccaggaauggguccagcacuucuaucaagaggccgcuccugcccaguccgacguggcgcuucugcgguuuguuaaucccgauacaagcagaguccucuucgaauguaagcugcauaaaucuggcuacgugacgguggcccacaccgggcagcacgaccuugugauuccgccuaacggcuauuuccgcuuugauagcuggguuaaccaguucuacacacuggcucccaugggaaauggcaccgggcggagacgcuga

SEQ ID NO: 30304 - RNA, 1614 nt, Artificial Sequence
  derived and/or modified sequence opt5 from VP1__Norovirus_and/or_Norovirus-like__AF425766
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucauucaggcucccggcggggaauuuacaguuagcccucggaacgcccccggagagauccugugguccgcgccucuuggcccggaucugaaucccuaccucucucaccuggcccgcauguauaacggguacgcuggaggcuucgaagugcaggucauucuugccggcaaugcuuuuacggccgggaaaaucaucuucgcggccgugccucccaacuuuccuaccgagggacugagccccucccagguuacaauguucccgcauauuaucguggacgucagacaacucgagccugugcugauuccccugccugaugugcggaauaacuuuuaucacuacaaucagucuaacgacagcaccaucaagcucauugcuaugcuguauacaccccuucgcgccaacaaugcuggcgaugacgucuucaccguuuccugcagagugcugacacggcccagcccugauuuugacuucaucuuucucgugccgcccaccgucgaaucucgcacgaaaccuuucaccgugcccauucugacaguugaggaaauguccaacagcagauuuccuaucccccuugagaagcuguacaccgggccgucuuccgccuucgugguccagccucagaauggacgguguacaaccgauggcgugcuccuggggacgacacaacugagcgccguuaacaucugcaccuuccgcggagacgugacacauauugcuggcucucacgauuauaccaugaaucucgcgucccagaacuggaauaacuacgaccccaccgaggaaaucccugcuccccugggcacaccugaccuugucgggaaaauucagggaaugcugacgcagaccacaagagaggauggcagcacccgggcccauaaggccacaguguccaccgggucuguccacuuuacgcccaagcucggaagcgugcaauacacaaccgacaccuccaaugauuuccagacaggccagaacaccaaauuuacaccgguuggggugauccaagacggaaauaaccaccagaaugaaccucagcaguggguccugcccaacuauagcggccgcacgggccauaaugugcaccuugcccccgcuguugccccuaccuucccgggggagcaacugcucuuuuucagaucuacaaugcccggauguuccggcuacccuaacaugaaccuggauugccugcucccccaggaaugggugcagcauuuuuaucaggaggcggcuccugcccaaagcgacgucgcccugcuucgguucgugaaucccgauaccgggcgcgugcuguuugaguguaagcuccacaaaucuggauacguuacagucgcucacaccggcccucaugaccuggugauucccccgaacggguauuucagauuugauagcugggugaaucaguucuacacgcuugccccuaugggcaacggagcuggccggagacgcuga

SEQ ID NO: 30305 - RNA, 1614 nt, Artificial Sequence
  derived and/or modified sequence opt5 from VP1__Norovirus_and/or_Norovirus-like__AJ583672
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaaccauuuucgcggccguuccucccaacuuuccuacagagggacugagccccucccaggugaccauguucccgcauaucaucgucgacgugagacaaccugagcccgugcucauuccucugcccgauguccggaauaacuuuuaucacuacaaucagucuaacgaccccacaaucaagcugauugcuaugcucuauaccccucugcgcgccaacaaugcuggcgaugacguuuucacagugagcugcagagugcuuacccggccgucccccgauuuugacuucaucuuucuggucccucccacgguggaaagccgcaccaaaccuuucacaguucccauucucaccguggaggaaaugacaaacucuagauuuccgaucccucuggagaaacuuuucaccgggcccuccaaugccuucgucgugcagccucagaacggacgguguacgacagauggcguucugcucgggaccacacaacugagccccgugaauauuugcaccuuucgcggagacgucacccauaucgccggcacacacgauuacacgaugaaccuggcuucucagaauuggaacaauuaugacccuaccgaggaaauccccgcgccgcucggcacaccugacuucguggggaagauucagggaguccugucccagaccacaagaggcgaugggagcacccggggacauaaggccacggugucuacaggcuccguucacuuuacccccaaacuugggagcgugcaauacaccacagacaccaacaaugaucuggaggcuggacaguccacaaaguucacgcccgucggcgugguucaggacggcaacaaucaccaaaacgaaccucagcagugggugcucccgaauuacucugggcgcaccggacauaacguccaccuggugcccgccguggccccuacauuucccggcgagcagcuucuguucuuuagaagcaccaugccuggguguuccggauaucccaacaugaaucucgauugccugcugccucaagaauggguucagcauuucuaccaggaggcugcccccgcgcagagcgacgucgcucuccugcgguuugugaacccggauacaggccgcgugcuuuucgaguguaagcugcacaaaucuggguaugucaccguggcccacacgggcccucaugaccucguuauucccccuaauggauacuuuagauucgauuccugggugaaccaauuuuauacccuggcccccaugggcaaugggacaggacggagacgcuga

SEQ ID NO: 30306 - RNA, 1614 nt, Artificial Sequence
  derived and/or modified sequence opt5 from VP1__Norovirus_and/or_Norovirus-like__AY532119
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugagcaauucuagauuuccuauuccccuugagaagcuguacaccgggccguccagcgccuucgucgugcagccucagaacggacgguguacaaccgauggcguucuccuggggacgacacaacugucugccgugaauaucugcaccuuccgcggagacgucacacauaucgcuggcucccacgauuauaccaugaaccucgcgagccagaauuggaacaauuacgaccccaccgaggaaauuccugcuccccugggcacaccugacuuuguggggaaaauccagggaaugcuuacgcagaccacaagagaggauggcuccacccgggcccauaaggccacagucucuaccgggagcgugcacuucacgcccaagcugggauccguucaauacacaaccgacaccaacagcgauuuucagacaggccagaauaccaaauucacaccggugggggucauucaagacggaaacaaucaccagaacgaaccucagcagugggugcuccccaauuauucuggccgcacgggccauaacguucaccuggcccccgcuguggccccuaccuuuccgggggagcaacuucuguucuuuagauccacaaugcccggauguagcggcuacccuaauaugaaccucgauugccugcugccccaggaauggguccagcauuucuaucaggaggcggcuccugcccaaucugacguggcccuccugcgguuugugaaccccgauaccgggcgcguucuuuucgaguguaagcugcacaaaagcggauacgucacaguggcucacaccggcccucaugaccucgugauucccccgaauggguauuuuagauucgauuccugggucaaccaguuuuacacgcuggccccuaugggcaauggagcuggccggagacgcuga

SEQ ID NO: 30307 - RNA, 1614 nt, Artificial Sequence
  derived and/or modified sequence opt5 from VP1__Norovirus_and/or_Norovirus-like__AF080552
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauaucgcuggcucucacgauuauaccaugaaucucgcgucccagaacuggaauaacuacgaccccaccgaggaaauuccugcuccccugggcacaccugacuuuguggggaaaauccagggaaugcuuacgcagaccacaagagaggauggcagcacccgggcccauaaggccacagucuccaccgggucugugcacuucacgcccaagcugggaagcguucaauacacaaccgacaccaauaacgauuuucagacaggccagaauaccaaauucacaccggugggggucauucaagacggaaacaaucaccagaacgaaccucagcagugggugcuccccaauuauuccggccgcacgggccauaacguucaccuggcccccgcuguggccccuaccuuuccgggggagcaacuucuguucuuuagaagcacaaugcccggauguucuggcuacccuaacaugaaucucgauugccugcugccccaggaauggguccagcauuucuaucaggaggcggcuccugcccaauccgacguggcccuccugcgguuugugaaccccgauaccgggcgcguucuuuucgaguguaagcugcacaaaagcggauacgucacaguggcucacaccggcccucaugaccucgugauucccccgucuggguauuuuagauucgauagcugggucaaucaguuuuacacgcuggccccuaugggcaacggagcuggccggagacgcuga

SEQ ID NO: 30308 - RNA, 1614 nt, Artificial Sequence
  derived and/or modified sequence opt5 from VP1__Norovirus_and/or_Norovirus-like__KX514177
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaaccccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaauagcagauuucccgucaaccuugaacggcuguucaccggaccgucuuccgccaaugugguucagccucagaacggccgcuguacaauugauggggagcuccugggaaccacgcaacugagcucugugaauaucugcacauucagaggcgacgucacccauaucggcacaacccagcacuggaccaugaaccucgccucccccaauuggaacaauuacgauccuacagaggaaacgcccgcuccucuggggacccccgacuuugugggaaagauucauggcaugcuuacacagaccacacaggagaacgggagcacccgggcgcaccgcgccacggucuaugugggauccgcuaauuucacaccgaaacugggcaagguucaauuugaaaccgacaccggggaugaccucgccaucagacagaacacaaaguucaccccugugggagucauucagucuagcgaucaccaucgggacgagccccaacaguggcgccugcccaauuacuccggcgccaacacauuuaaugugcaccuugcuccugccguugcgccgaacuuccccggcgaacagcugcucuuuuucagaagcacgcugccuggguguggaggccaucccaacauggaucuggacugccuccugccucaggagugggugcaacacuuuuaccaggaggcugcccccgcccagucugaugucgcccuucugcgguucgugaauccugacaccuccagagugcucuuugaauguaaacugcacaagagcggguauguuacagucgcucauaccggacaguacgaucuugugcugcccucuaacggcuauuuccgcuuugacagcugggugaaucaauucuacacacucgcuccgauggggaacggcaccggacggagacgcuga

SEQ ID NO: 30309 - RNA, 1614 nt, Artificial Sequence
  derived and/or modified sequence opt5 from VP1__Norovirus_and/or_Norovirus-like__KF806514
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuggagccuucgugguucagccccagaauggccgguguaccacagacggggugcuccugggaaccacgcaacuguccccugucaacauuugcacauuucgcggcgaucucacccauuucacaggcaccagcgaauacgcuaugaaucuggcgucucagaacugggacaauuaugaucccaccgaggaaaucccugcuccccuuggggccccggacuuugugggaaagaucagaggcaugcugacacagacgacccggcgcgacggguccacaagaggacaccgggccacccucagcacaggcuccgcccauuucaccccuaagcuggggaacauucgcuuuucuacggauacaaauaacgacuucgaggcuggacagaauaccaaauuuacccccgucggcguguuccaagaaggcgauaaccaccagaaugagccccagcaauggguucuuccuaacuacagcggggccacagcgcacaaugugcaucuggcuccggccgucgcccccgcuuuuccuggagagcagcuccuguucuuuagauccaccaugcccggcugugggggauacccuaacaugaaucuggacugccuccugccccaggaaugggugcagcacuucuaucaagaggccgcuccugcccagagcgauguugcgcuucugcgguuugugaaccccgacacaucuagaguccucuucgaauguaagcugcauaaauccggcuacgugacgguggcccacaccgggcagcacgaucuuguuaucccgccuaacggcuauuuccgcuuugacagcugggucaaucaguucuacacacuggcucccaugggaaacggcaccgggcggagacgcuga

SEQ ID NO: 30310 - RNA, 1614 nt, Artificial Sequence
  derived and/or modified sequence opt5 from VP1__Norovirus_and/or_Norovirus-like__AB303925
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguucaccgggccgucuuccgccuucgucgugcagccucagaauggacgguguacaaccgauggcguucuccuggggacgacacaacugagcgccgugaacaucugcaccuuucgcggagacgucacacauaucgcuggcucucacgauuacaccaugaaucucgcgucccagaacuggaauaacuaugaccccaccgaggaaauuccugcuccccugggcacaccugacuucguggggaaaauccagggaaugcuuacgcagaccacaagagaggauggcagcacccgggcccauaaggccacagucuccaccgggucugugcacuuuacgcccaagcugggaagcguucaauacacaaccgacaccaauaacgauuuccagacaggccagaauaccaaauuuacaccggugggggucauucaagacggaaacaaucaccagaacgaaccucagcagugggugcuccccaauuacuccggccgcacgggccauaacguucaccuggcccccgcuguggccccuaccuucccgggggagcaacuucuguuuuucagaagcacaaugcccggauguucuggcuauccuaacauggaucucgacugccugcugccccaggaauggguccagcauuuuuaccaggaggcggcuccugcccaauccgauguggcccuccugcgguucgugaaucccgacaccgggcgcguucuuuuugaguguaagcugcacaaaagcggauaugucacaguggcucacaccggcccucaugaucucgugauucccccgaacggguacuucagauuugacucuuggaucaaucaguucuauacgcuggccccuaugggcaacggagcuggccggagacgcuga

SEQ ID NO: 30311 - RNA, 1614 nt, Artificial Sequence
  derived and/or modified sequence opt5 from VP1__Norovirus_and/or_Norovirus-like__KF806534
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuuccgccuucgugguucagccccagaauggacgguguaccacagacggcgugcuccuggggaccacgcaacugagcccugucaacauuugcacauuucgcggagaucucacccauuucgcuggcacaucugaauacgcgaugaaucuggccucccagaacuggaccaauuaugaccccaccgaggaaaucccugcuccccuuggcgccccggauuuuguggggaagaucagaggaguccugacacagacgacccggcgcgacggcagcacaagagggcaccgggccacccucuccacaggaucugcucauuucaccccuaagcugggcagcauucgcuuuuccacggacacaaacaaugauuucgaggccgggcagaacaccaaauuuacccccgugggaguuuuccaagacggcgauaaucaccagaacgaaccccagcaaugggugcuuccuaauuacagcggcgcgacagcucacaacguccaucuggccccggccguggcucccgccuuuccuggggagcagcuccuguucuuuagaucuaccaugcccggauguuccggcuacccuaauaugaaccuggacugccuccugccccaggaguggguucagcacuucuaucaagaagcugccccugcgcagagcgauguggcccuucugcgguuugucaaucccgacacaucuagaguucucuucgaguguaagcugcauaaaagcggguacgugacgguggcucacaccggacagcacgaucuugucaucccgccuaacggcuauuuccgcuuugacuccugggugaaccaguucuacacacuggcccccauggggaauggcaccggacggagacgcuga

SEQ ID NO: 30312 - RNA, 1614 nt, Artificial Sequence
  derived and/or modified sequence opt5 from VP1__Norovirus_and/or_Norovirus-like__KF806519
augaagauggccagcaacgacgcuucccccucugauggcagcgccgcgaaucuggugccugaggucaacaaugaaguuauggcucucgagccgguggugggggccaccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucgucguggacgugagacaacucgagccuguccugauuccccugccugauguucggaacaauuuuuaucacuacaaccagagcaaggaccccaccaucaaacucauugcuaugcuguauacaccccuucgcgccaauaacgcuggcgaagauguguucaccguguccugcagaguccugacacggccuagcccggacuuugauuucaucuuucucgugucucccaccguugagucccgcagcaagccuuucacggugcccauucugaccgucgaagagaugacaaacucuagauuuccuaucccccuugagaaacuguucaccgggccguccggagccuucgugguucagccucagaauggccgguguacaaccgacggggugcuccugggaacgacacaacugagccccgucaacauuugcaccuuucgcggcgaucucacacauuucaccggcaccucugaauacgccaugaaucuggcuucccagaacuggaauaacuaugacccuacagaggaaauccccgcgccucuuggggcccccgauuuugugggaaagaucagaggcaugcugacgcagaccacacggcgcgacgggagcaccagaggacaccgggcuacacucuccaccggcucugcccauuucacgccgaagcuggggaauauucgcuuuagcacagacaccaacaaugauuucgaggccggacagaacaccaaauuuacaccugucggcguguuccaagaaggcgacaaucaccagaacgagccccagcaauggguucuucccaauuacuccggggcuaccgcccacaacgugcaucuggcgccugcugucgccccggccuuucccggagagcagcuccuguucuuuagaagcacaaugccuggcugugggggauaccccaauaugaaccuggauugccuccugccucaggaaugggugcagcacuucuaucaagaggcugcccccgcucagucugacguugcccuucugcgguuugugaacccugauacguccagaguccucuucgaauguaagcugcauaaaagcggcuacgugaccguggcgcacacagggcagcacgaccuuguuauucccccgaauggcuauuuccgcuuugauucuugggucaaccaguucuacacccuggccccuaugggaaauggcacagggcggagacgcuga

SEQ ID NO: 30313 - RNA, 1614 nt, Artificial Sequence
  derived and/or modified sequence opt5 from VP1__Norovirus_and/or_Norovirus-like__AB303924
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguuuugcagagugcugacacggcccuccccugauuucgacuuuauuuuccucgucccgcccaccguggaaagccgcacgaaaccuuuuaccguucccauccugacaguggaggaaaugucuaacuccagauucccuauuccccuugagaagcuguacaccgggccgagcucugccuucgucgugcagccucagaauggacgguguacaaccgauggcguucuccuggggacgacacaacuguccgccgugaacaucugcaccuuucgcggagacgucacacauaucgcuggcagccacgauuauaccaugaaucucgcgucucagaacuggaauaacuacgaccccaccgaggaaauuccugcuccccugggcacaccugacuucguggggaaaauccagggaaugcuuacgcagaccacaagagaggauggcuccacccgggcccauaaggccacagucagcaccggguccgugcacuuuacgcccaagcugggaucuguucaauacacaaccgacaccaauaacgauuuccagacaggccagaauaccaaauuuacaccggugggggucauucaagacggaaacaaucaccagaacgaaccucagcagugggugcuccccaauuauagcggccgcacgggccauaacguucaccuggcccccgcuguggccccuaccuucccgggggagcaacuucuguuuuucagauccacaaugcccggauguagcggcuacccuaacaugaaucucgauugccugcugccccaggaauggguccagcauuuuuaucaggaggcggcuccugcccaaucugacguggcccuccugcgguucgugaaccccgauaccgggcgcguucuuuuugaguguaagcugcacaaauccggauacgucacaguggcucacaccggcccucaugaccucgugauucccccgaauggguauuucagauuugauagcugggucaaccaguucuacacgcuggccccuaugggcaauggagcuggccggagacgcuga

SEQ ID NO: 30314 - RNA, 1614 nt, Artificial Sequence
  derived and/or modified sequence opt5 from VP1__Norovirus_and/or_Norovirus-like__DQ975270
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcacguauaacggguacgcuggaggcuucgaaguccaggugauccuugccggcaaugcuuuuaccgccgggaaaauuaucuucgcggccguuccucccaacuuuccuacagagggacugagccccucccaggugaccauguucccgcauaucauugucgacgugagacaacucgagccugugcugaucccccugccugauguccggaauaacuuuuaucacuacaaucagucuaacgacagcacaauuaagcucaucgcuaugcuguauacaccccuucgcgccaacaaugcuggcgaugacguuuucaccguguccugcagagugcugacccggcccagcccugauuuugacuucauuuuucucgucccgcccacgguggaaucucgcaccaaaccuuucacaguucccauccugaccguggaggaaauguccaacagcagauuuccuauuccccuugagaagcuguacacagggccgucuuccgccuucgucgugcagccucagaauggacgguguaccacggauggcguucuccuggggacaacccaacugagcgccgugaacaucugcacauuccgcggagacgucacccauaucgcuggcucucacgauuauaccaugaaucucgcgucccagaacuggaauaacuacgaccccacagaggaaauuccugcuccccugggcacgccugacuuuguggggaaaauccagggaaugcuuacccagacaaccagagaggauggcagcacacgggcccauaaggccaccgucuccacggggucugugcacuucacacccaagcugggaagcguucaauacaccaccgacacaaauaacgauuuucagaccggccagaauacaaaauucacgccggugggggucauucaagacggaaacaaucaccagaacgaaccucagcagugggugcuccccaauuauuccggccgcaccggccauaacguucaccuggcccccgcuguggccccuacauuuccgggggagcaacuucuguucuuuagaagcaccaugcccggauguucuggcuacccuaacaugaaucucgauugccugcugccccaggaauggguccagcauuucuaucaggaggcggcuccugcccaauccgacguggcccuccugcgguuugugaaccccgauacagggcgcguucuuuucgaguguaagcugcacaaaagcggauacgucaccguggcucacacgggcccucaugaccucgugauucccccgaauggguauuuuagauucgauucuugggucaaccaguuuuacacccuggccccuaugggcaauggagcuggccggagacgcuga

SEQ ID NO: 30315 - RNA, 1614 nt, Artificial Sequence
  derived and/or modified sequence opt5 from VP1__Norovirus_and/or_Norovirus-like__AF414424
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugggccaacucgagccugugcugaucccccugccugaugucagaaauaacuuuuaucacuacaaucagucuaacgacagcaccauuaagcucaucgcuaugcuguauacaccccuucgggccaacaaugcuggggaugacguuuucaccguguccugccgcgugcugacaagacccagcccugauuuugacuucauuuuucucgucccgcccaccguggaaucucggacgaaaccuuucaccguucccauccugacaguggaggaaauguccaacagccgcuuuccuauuccccuugagaagcuguacaccggaccgucuuccgccuucgucgugcagccucagaauggcagauguacaaccgaugggguucuccugggaacgacacaacugagcgccgugaacaucugcaccuuccggggcgacgucacacauaucgcuggcucucacgauuauaccaugaaucucgcgucccagaacuggaauaacuacgaccccaccgaggaaauuccugcuccccuggggacaccugacuuugugggaaaaauccagggcguccuuacgcagaccacacgcgaggaugggagcaccagagcccauaaggccacaguguccaccggaucuguucacuucacgcccaagcugggcagcgugcaauacacaaccgacaccaauaacgauuuucagacagggcagaauaccaaauucacaccggucggagugauucaagacggcaacaaucaccagaacgaaccucagcaguggguucuccccaauuauuccggccggacggggcauaacgugcaccuggcccccgcugucgccccuaccuuuccgggagagcaacuucuguucuuucgcagcacaaugcccggcuguucuggguacccuaacaugaaucucgauugccugcugccccaggaaugggugcagcauuucuaucaggaggcggcuccugcccaauccgacguggcccuccugagauuuguuaaccccgauaccggacggguccuuuucgaguguaagcugcacaaaagcggcuacgugacaguggcucacaccgggccucaugaccucgucacgcccccgaauggcuauuuucgcuucgauucuugggugaaccaguuuuacacccuggccccuaugggaaauggcgcugggagacggagauga

SEQ ID NO: 30316 - RNA, 1614 nt, Artificial Sequence
  derived and/or modified sequence opt5 from VP1__Norovirus_and/or_Norovirus-like__LC048964
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaagcaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugagcaauucuagauuuccuauuccccuugagaagcuguacaccgggccguccagcgccuucgucgugcagccucagaacggacgguguacaaccgauggcguucuccuggggacgacacaacugucugccgugaauaucugcaccuuccgcggagacgucacacauaucgcuggcucccacgauuauaccaugaaccucgcgagccagaauuggaacaauuacgaccccaccgaggaaauuccugcuccccugggcacaccugacuuuguggggaaaaaccagggacuucugucccagacgaccagaggcgaugggucuacacgggcccauaaggccaccgucagcacaggauccgugcacuucacccccaagcucggcagcguucaauacacgacagacaccaauaacgauuuugagaccgggcagaauacaaaauucaccccggugggagucauccaggacggcaacaaucaccaaaacgaaccucagcagugggcccugcccaauuauucuggccgcacagggcauaacgugcaccuugcucccgccguugcgccuacguuuccgggagagcagcuccuguucuuuagauccaccaugcccggcuguagcggguacccuaacaugaaucuggauugccugcucccccaagaaugggugcagcauuucuaucaggaggcugccccugcccagucugacgucgcucugcuucgguuugugaaccccgauacaggacgcgugcuguucgaguguaagcuccacaaaagcggcuacguuaccgucgcccacacagggccucaugaccuggugauucccccgaauggcuauuuuagauucgauuccugggugaaccaauuuuacacccuugcuccuaugggaaauggcgccgggcggagacgcuga

SEQ ID NO: 30317 - RNA, 1614 nt, Artificial Sequence
  derived and/or modified sequence opt5 from VP1__Norovirus_and/or_Norovirus-like__AB684705
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacaucaucgacccuuggauuagaaauaacuucgugcaggcccccggcggggaauuuaccguuuccccucggaaugcgcccggagagauccuguggucugccccucuuagcccggaucugaaccccuaccucucccaccugucucgcauguauaauggcuacgcugggggauucgaagugcaggucauucuugccggcaacgcuuuuacagccggcaaagugaucuucgcggccguuccucccaauuuuccuacggaggggcugagccccucccaggugaccauguucccgcauaucauugucgacgugagacaacucgagccugugcugaucccccugccugauguccggaacaauuuuuaucacuacaaccagacacaugacagcacccucaagcugauugcuaugcuuuauacaccccugcgcgccaauaacgcuggagaugacguuuucaccgugucuugcagagugcucacacggcccuccccugauuuugacuucaucuuucuggucccgcccaccguggaaagccgcacgaaaccuuucaccguucccauucuuacaguggaggaaaugucuaacuccagauuuccuaucccccuggagaagcucuacaccggcccgagcucugccuucgucgugcagccucagaaugggcgguguacaaccgauggaguucugcugggcacgacacaacucuccgccgugaacauuugcaauuuccgcggggacgucaccagagugggaaucagccacgauuauacaaugaaccuggucucccagaauuggaacaauuacgaccccaccgaggaaaucccugcuccccuuggcaccccugacuuugugggcaaaauucaggggcugcucacacagacgacccgggcggauucuagcacacgcgcccauaaggcuacccuguccacaggaagcguucacuucacccccaaacuuggcucugugcaauuuacgacagacaccaacaaugauuuccagaccgggcagaacacaaaguuuaccccggucggagugauccaagacuccgaucaccaucagaaugagccucagcaguggguucugcccaacuacagcggcucuagcgggcacaaugugcaucucgcccccgccgucgcuccuacauucccgggagaacaacugcuguuuuucagauccacgaugcccggcuguucuggcuauccuaacaugaaucucgacugccugcuuccccaggagugggugcugcacuuuuaccaggaagccgcgccugcucagagcgauguggcccuccugcgguucguuaaccccgacaccgggcgcguccuuuuugaguguaagcugcacaaauccggauauauuacaguggcccauaccggcccuuacgaucucgugauucccccgaacggguauuucagauuugacagcugggucaaucaauucuacacacuggcuccuaugggaaacggcaccgggcggagacgcuga

SEQ ID NO: 30318 - RNA, 1614 nt, Artificial Sequence
  derived and/or modified sequence opt5 from VP1__Norovirus_and/or_Norovirus-like__KF806523
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugucucccacaguugagucccgcagcaagccuuucaccgugcccauucugacggucgaagagaugaccaacucuagauuuccuaucccccuugagaaacuguucacagggccguccggagccuucgugguucagccucagaauggccgguguaccacagacggggugcuccugggaaccacgcaacugagccccgucaacauuugcacauuucgcggcgaucucacccauuucacaggcaccucugaauacgcuaugaaucuggcgucccagaacuggaauaacuaugacccuaccgaggaaauccccgccccucuuggggcucccgauuuugugggaaagaucagaggcaugcugacacagacgacccggcgcgacgggagcacaagaggacaccgggccacccucuccacaggcucugcccauuucaccccgaagcuggggaauauucgcuuuagcacggacacaaacaaugauuucgaggcuggacagaacaccaaauuuaccccugucggcguguuccaagaaggcgacaaucaccagaacgagccccagcaauggguucuucccaauuacuccggggccacagcgcacaacgugcaucuggcuccugccgucgccccggcuuuucccggagagcagcuccuguucuuuagaagcaccaugccuggcugugggggauaccccaauaugaaccuggauugccuccugccucaggaaugggugcagcacuucuaucaagaggccgcucccgcccagucugacguugcgcuucugcgguuugugaacccugauacauccagaguccucuucgaauguaagcugcauaaaagcggcuacgugacgguggcccacaccgggcagcacgaccuuguuauucccccgaauggcuauuuccgcuuugauucuugggucaaccaguucuacacacuggcuccuaugggaaauggcaccgggcggagacgcuga

SEQ ID NO: 30319 - RNA, 1614 nt, Artificial Sequence
  derived and/or modified sequence opt5 from VP1__Norovirus_and/or_Norovirus-like__AY532129
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucacggcggggaauuuacagugagcccccggaacgccccuggagagauucugugguccgcgccccuuggcccugaucugaauccguaccucucucaucuggcccgcauguauaacggguacgcuggaggcuucgaaguccaggugauccuugccggcaaugcuuuuacggccgggaaaauuaucuucgcggccguucccccuaacuuucccaccgagggacugagcccuucccaggugacaauguucccccacaucauugucgacgugagacaacucgagccggugcugaucccucugcccgauguccggaauaacuuuuaucauuacaaucagucuaacgacagcaccauuaagcucaucgcuaugcuguauacaccucuucgcgccaacaaugcuggcgaugacguuuucaccguguccugcagagugcugacacggcccagccccgauuuugacuucauuuuucucgucccuccgaccguggaaucucgcacgaaacccuucaccguuccuauccugacaguggaggaaauguccaacagcagauuucccauuccucuugagaagcuguacaccgggcccucuuccgccuucgucgugcagccgcagaauggacgguguacaaccgauggcguucuccuggggacgacacaacugagcgccgugaacaucugcaccuuccgcggagacgucacacacaucgcuggcucucaugauuauaccaugaaucucgcgucccagaacuggaauagcuacgacccuaccgaggaaauucccgccccucugggcacacccgacuuuguggggaaaauccagggaaugcuuacgcagaccacaagagaggauggcuccacccgggcucacaaggccacagucucuaccgggagcgugcacuucacgccuaagcugggauccguucaauacacaaccgacaccaacaaugauuuucagacaggccagaacaccaaauucacacccgugggggucauucaagacggaaauaaccaucagaaugaaccgcagcagugggugcucccuaacuauagcggccgcacgggccacaauguucaucuggcccccgcuguggcccccaccuuuccuggggagcaacuucuguucuuuagaucuacaaugccgggauguuccggcuaccccaacaugaaccucgauugccugcugccucaggaauggguccagcacuucuaucaggaggcggcucccgcccaaagcgacguggcccuccugcgguuugugaauccugauaccgggcgcguucuuuucgaguguaagcugcacaaaucuggauacgucacaguggcucauaccggcccccacgaccucgugaucccucccaacggguauuuuagauucgauagcugggucaaucaguuuuacacgcuggccccgaugggcaacggagcuggccggagacgcuga

SEQ ID NO: 30320 - RNA, 1614 nt, Artificial Sequence
  derived and/or modified sequence opt5 from VP1__Norovirus_and/or_Norovirus-like__AY532124
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccagaaaugcuuuuacggccggcaaaguuauuuucgcggccgugccucccaacuuuccuaccgaggggcugagccccucccaggucacaauguucccgcauaucaucguggacgugcggcaacucgagccuguccugauuccccugccugauguucgcaauaacuuuuaucacuacaaucagucuaacgacagcaccaucaagcucauugcuaugcuguauacaccccuuagagccaacaaugcuggagaugacguguucaccguguccugccggguccugacacgccccagcccugauuuugacuucaucuuucucgugccgcccaccguugaaucuagaacgaaaccuuucaccgugcccauucugacagucgaggaaauguccaacagccgguuuccuaucccccuugagaagcuguacaccggcccgucuuccgccuucgugguucagccucagaaugggcgcuguacaaccgauggagugcuccugggcacgacacaacugagcgccgucaacauuugcaccuucagaggggacgugacacauaucgcuggaucucacgauuauaccaugaaucucgcgucccagaacuggaauaacuacgaccccaccgaggaaaucccugcuccccugggcacaccugacuuugucggcaaaauucaggggaugcuuacgcagaccacacgggaggauggaagcacccgcgcccauaaggccacaguguccaccggcucuguucacuucacgcccaagcuggggagcgugcaauacacaaccgacaccaauaacgauuuucagacaggacagaauaccaaauucacaccggucggcgugauccaagacgggaacaaucaccagaacgaaccucagcaguggguucuccccaauuauuccggaagaacgggccauaacgugcaccuggcccccgcugucgccccuaccuuuccgggcgagcaacuucuguucuuucggagcacaaugcccggguguucuggauacccuaacaugaaucucgauugccugcugccccaggaaugggugcagcauuucuaucaggaggcggcuccugcccaauccgacguggcccuccugcgcuuuguuaaccccgauaccggcagaguccuuuucgaguguaagcugcacaaaagcggguacgugacaguggcucacaccggaccucaugaccucgucauucccccgaauggcuauuuucgguucgauucuugggugaaccaguuuuacacgcuggccccuauggggaauggcgcuggaagacgccgguga

SEQ ID NO: 30321 - RNA, 1614 nt, Artificial Sequence
  derived and/or modified sequence opt5 from VP1__Norovirus_and/or_Norovirus-like__KX514309
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaucccggcgaugacguuuucaccguguccugcagagugcugacccggccuagcccggauuuugacuucauuuuucucgugcccccuacagucgaaucucgcaccaaacccuucuccguuccuauccugacggugggggagaugaccaacagcagauuucccauuaaucuugaacggcuguucacaggaccgucuuccgccaacgucgugcagccucagaauggccgcuguaccaucgauggggagcuccugggaacaacccaacugagcucuguuaacaucugcacguucagaggcgacgugacacaucccggcggguccaagauuuacaccaugaaucucgccagcccuaacuggaauaacuaugaucccacagaggaaaucccugcuccccugggaaccccggacuuugucggcaaaauucacgggaugcuuacccagacaacgaagggagagggcuccacccgggggcaucgcgcgacaguguacgucggaggcgccaauuucaccccuaagcugggcaaagugcaguuugaaacagacaccggggaugaccucgcuaucagacagaacacgaaguucacacccguuggagugauucaaucuagcgaucaccaccgggacgagccccagcaguggcgccugccuaauuacuccggcgccaacaccuuuaauguccaucuugccccggcuguggcccccaacuucccuggggaacaacugcucuuuuucagaagcacccugcccggauguggcgggcacccuaacauggaucuggacugccuccugccccaggaguggguucagcauuuuuaucaggaggcggcuccugcccaaucugauguggcccuucugcgguucgucaaucccgacacauccagagugcucuuugaauguaaacugcacaagagcggcuacgugaccguugcucacacaggacagcaugaucuugucaucccgccuaacggcuauuuccgcuuugacucuugggugaaucaguucuacacgcuggcccccauggggaacggaaccggccggaaaagauga

SEQ ID NO: 30322 - RNA, 1614 nt, Artificial Sequence
  derived and/or modified sequence opt5 from VP1__Norovirus_and/or_Norovirus-like__KX514308
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaauucuagauuucccauuaaccuugauaagcuguucaccggaccguccagcgcuaaugucgugcagccucagaacggccgguguacaaucgacggggaacuccugggaaccacgcaacugucuuccguuaauaucugcacauuccgcggcgaugugacccauauuggcagcacaagacacuggaccaugaaccucgccucccccaauuggaacaauuacgacccuaccgaggagacacccgccccucuggggacgcccgacuuugucggaaaaauccauggcaugcuuacccagacaacccaggaaaacgggucuacacgggcucaccgcgcgaccguguaugucggaagcgccgauuucacgccgaagcugggcaaggugcaguuugagacagacaccgaagaugaccucgcuauuagacaaaauaccaaauucacaccuguuggggugauccaguccagcgaucaccaucgggacgagccccagcaauggcgccugcccaacuacucuggagccaauaccuuuaacguccaccuugccccugcuguggccccgaauuuccccggcgaacagcugcucuuuuucagauccacacugccuggcugugggggacaucccaacauggaucuggacugccuccugccucaggaguggguucagcacuuuuaccaagaggcggcucccgcccagagcgauguggcccuucugcgguucgucaacccugacacgucuagagugcucuuugaauguaagcugcacaaaagcggcuaugugaccguugcucauacagggcaguacgaucuuguccugcccuccaauggauauuuccgcuuugacucuugggugaaccaguucuacacccucgccccgaugggcaaugggacaggccggagacgcuga

SEQ ID NO: 30323 - RNA, 1614 nt, Artificial Sequence
  derived and/or modified sequence opt5 from VP1__Norovirus_and/or_Norovirus-like__KX514283
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaaggacagcacaauuaaacucaucgccaugcuguauacgccccuucgcgcuaacaacgccggcgaugacguuuucacaguguccugcagagugcugacccggcccagcccugauuuugacuucauuuuucucgucccgcccacaguggaaucucgcuccaagccuuucagcguucccgugcugaccgucgaggaaaugaccaauucuagauuuccugugacccuugauaaacuguucacagggcccuccagcaccaucguugugcagccgcagaacggacgguguaugauugacggcguccuccuggggacaacccaacugucuccugugaauaucugcacguuccgcggagaugucacacaucccagagacuccaccaucuacacaaugaaccucgccagcccuaauuggaacaauuaugaccccaccgaggagauuccugcuccccugggcaccccggauuuuacaggcaagauccaggggaugcuuacgcagaccacaaagggagaaggcuccacccgggggcaccgcgcgacaguguacguuggaucugccgaguucaccccuaaacugggcaaggugagauuugaaacggacacagaggaugaccucgucauucggcagaacaccaaauucacccccguggggguuauccaaagcuccgaucaucaccgcgacgaaccccagcaguggagacugccuaauuacagcggagcuaacacauuuaaugugcaccuugccccggccgucgcucccaacuucccuggcgagcaacugcucuuuuuccggucuacccugcccggcugugggggacauccuaauauggaucuggacugccuccugccccaggagugggugcagcacuuuuaucaggaagccgcgccugcucaauccgauguggcccuucugagauucguuaaccccgacacaagccgcguccucuuugaguguaagcugcauaaaucuggcuacgugacgguggcccacaccgggcaguaugaucuuguccugccgagcaauggauacuuccgguuugacuccugggugaaccaguucuauacacucgcuccuaugggcaacgggaccggcagacgccgguga

SEQ ID NO: 30324 - RNA, 1614 nt, Artificial Sequence
  derived and/or modified sequence opt5 from VP1__Norovirus_and/or_Norovirus-like__KX514194
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaacggcuguucaccggaccguccagcgccaacgucgugcagccucagaauggccgcuguacaaucgauggggagcuccugggaaccacgcaacugucuuccguuaacaucugcacauucagaggcgacgugacccauauuggcagcacacaccauuggaccaugaaucucgccucccccaacuggaauaacuacgauccuaccgaggaaacacccgcuccucuggggacgcccgacuuugucggaaagauccacggcaugcuuacccagacaacccaggggaauggaucuacacggggccaccgcgcgaccguguaugucgggagcgccgaguucacgccgaaacugggaaaggugcaguuuaagacagaaaccgaccaugaucucgcuauuagacaaaacaccaaauucacaccuguuggcgugauccaggaguccgaccaccaucgggaugaaccccagcaauggcgccugcccaauuacagcggcgccaacaccuuuaauguccaccuugccccugcuguggccccgaacuuccccggggagcagcugcucuuuuucagaucuacacugccuggauguggcgggcaccccaauauggaccuggauugccuccugccucaggaguggguucagcauuuuuaccaagaagcggcucccgcccaguccgacguggcccuucugcgguucgucaacccugauacgagcagagugcucuuugaguguaagcugcacaaaucuggauaugugaccguugcucauacaggccaguacgaccuuguccugcccagcaacggguauuuccgcuuugauuccugggugaaucaguucuacacccucgccccgaugggcaacggaacaggccggagacgcuga

SEQ ID NO: 30325 - RNA, 1614 nt, Artificial Sequence
  derived and/or modified sequence opt5 from VP1__Norovirus_and/or_Norovirus-like__KY424340
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacaucaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccagucccaugacagcacacucaagcugauugcuaugcuuuauacaccccugcgcgccaauaacgcuggcgaugacguuuucaccgugucuugcagagugcucacccggcccuccccugauuuugacuucaucuuucuggucccgcccacaguggaaagccgcaccaaaccuuucacgguucccauucuuaccguggaggaaaugucuaacuccagauuuccuaucccccuggagaagcucuacacagggccgagcucugccuucgucgugcagccucagaauggacgguguaccacagauggcguucugcuggggaccacgcaacucuccgccgugaacauuugcaauuuccgcggagacgucacacacaucgugggcagccaugauuauaccaugaaccuggcuucccagaauuggucuaacuacgaccccacagaggaaaucccugcgccccuuggcaccccugacuuugucgggaaaauucagggacugcucacccagacaacgagagccgauggcagcacccgggcucacaaggccacaguguccaccgggagcguucacuucacacccaagcugggaucugugcaauuuaccacggacacaaauaacgauuuccagaccggccagaauaccaaauuuacaccggucggggugauccaagacggagaucaucaccagaacgagccucagcaguggguucuucccaauuacuccggccgcaccggccauaacgugcaccuggcccccgcugucgccccuacauucccgggggaacaacuccuguuuuucagaagcacgaugcccggauguucuggcuauccuaauaugaaccuggacugccuccugccccaggagugggugcuucacuuuuaccaggaagcggcuccugcccagagcgauguggcccugcuccgguucguuaaucccgacaccgggcgcguccuguuugaguguaaacuucauaaguccggauauauuacaguggcucacaccggcccuuacgaucuggugauucccccgaacggguauuucagauuugacucuugggucaaccaauucuacacacucgccccuaugggcaauggaaccggccggagacgcuga

SEQ ID NO: 30326 - RNA, 1614 nt, Artificial Sequence
  derived and/or modified sequence opt5 from VP1__Norovirus_and/or_Norovirus-like__LC016606
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcacccacacauacagaaugaaccucgccucccagaauuggaacaauuaugauccuacggaggaaauucccgcuccucugggcacccccgacuucguggggaaaauccagggaaugcuuacacagaccacaaagggcgacgggagcacccggggacauaaggcgacggucuccacaggcucuguggauuuuaccccgaaacuggggagcguucaauucgccaccgacacaaacaaugauuuugagaccggacagaacacacgcuucacgccugugggcgucauucaggacggcuccgcucacagaaaugaaccccaacagugggugcuccccgauuacagcgggaagaccguucacaacgugcaucuggccccugccgucgcuccgacauuucccggagagcagcuucuguucuuucggucuaccaugccuggcuguuccggguaccccaauauggaccucgauugccugcugccucaggaaugggugcaacacuucuaucaggaggccgcgcccgcucagagcgacguggcccuccugcgcuuuguuaacccugauacaggaagaguccuuuucgaguguaaacugcauaagaccggcuacgugacgguggcccacaccgggcagcacgaccucgucauucccccgaauggcuauuuucgguucgauucuugggugaaccaauucuacacacuggcuccuaugggaaacggcgccgggagacgccgguga

SEQ ID NO: 30327 - RNA, 1614 nt, Artificial Sequence
  derived and/or modified sequence opt5 from VP1__Norovirus_and/or_Norovirus-like__FJ537136
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacaucaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccagucccaugacagcacacucaagcugauugcuaugcuuuauacaccccugcgcgccaauaacgcuggcgaugacguuuucaccgugucuugcagagugcucacccggcccuccccugauuuugacuucaucuuucuggucccgcccacaguggaaagccgcaccaaaccuuucacgguucccauucuuaccguggaggaaaugucuaacuccagauuuccuaucccccuggagaagcucuacacagggccgagcucugccuucgucgugcagccucagaauggacgguguaccacagauggcguucugcuggggaccacgcaacucuccgccgugaacauuugcaauuuccgcggagacgucacacacaucgugggcagccaugauuauaccaugaaccuggucucccagaauuggucuaacuacgaccccacagaggaaaucccugcuccccuuggcaccccugacuuuguggggaaaauucagggacugcucacccagacaacgagagcggauggcagcacccgggcccacaaggcuacaguuuccaccgggagcgugcacuucacacccaagcugggaucuguccaauuuaccacggacacaaauaacgauuuccagaccggccagaauaccaaauuuacaccgguggggguuauccaagacggagaucaucaccagaacgagccucagcagugggugcuucccaauuacuccggccgcaccggccauaacguccaccuggcccccgccguggcuccuacauucccgggggaacaacuccuguuuuucagaagcacgaugcccggauguucuggcuauccuaauaugaaccuggacugccuccugccccaggagugggugcuucacuuuuaccaggaagccgcgccugcucagagcgauguugcccugcuccgguucgucaaucccgacaccgggcgcgugcuguuugaguguaaacuucauaaguccggauauauuacaguggcccacaccggcccuuacgaucuggucauucccccgaacggguauuucagauuugacucuugggugaaccaauucuacacacucgcuccuaugggcaauggaaccggccggagacgcuga

SEQ ID NO: 30328 - RNA, 1614 nt, Artificial Sequence
  derived and/or modified sequence opt5 from VP1__Norovirus_and/or_Norovirus-like__AY532117
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucugggccccuggggagaauuuacagugagcccucggaacgcucccggggagauucuuugguccgccccucugggcccggaucucaaucccuaccugucucaccuugcgcgcauguauaacggguacgccggaggcuucgaaguccaggugauccuggcuggcaaugccuuuacggcugggaaaauuaucuucgccgcgguuccucccaacuuuccuaccgagggacucagccccucccaggugacaauguucccgcauaucauugucgacgugagacagcuggagccugugcugaucccccucccugauguccggaauaacuuuuaucacuacaaucaaucuaacgacagcaccauuaagcugaucgccaugcuuuauacaccccugcgcgcuaacaaugccggcgaugacguuuucaccguguccugcagagugcucacacggcccagcccugauuuugacuucauuuuucuggucccgcccaccguggaaucucgcacgaaaccuuucaccguucccauccuuacaguggaggaaauguccaacagcagauuuccuauuccccuggagaagcucuacaccgggccgucuuccgcuuucgucgugcagccucagaauggacgguguacaaccgauggcguucugcuggggacgacacagcucagcgccgugaacaucugcaccuuccgcggagacgucacacauaucgccggcucucacgauuauaccaugaaucuggcuucccaaaacuggaauaacuacgaccccaccgaggaaauuccugcgccccuuggcacaccugacuuuguggggaaaauccagggaguccugacgcagaccacaagagaggauggcagcacccgggcccauaaggcuacaguguccaccgggucuguucacuucacgcccaagcucggaagcgugcaguacacaaccgacaccuccaaugauuuucaaacaggccagaacaccaaauucacaccggucggggugauucaggacggaaauaaccaccaaaaugaaccucagcaguggguucugcccaacuauagcggccgcacgggccauaaugugcaccuugcccccgccgucgcuccuaccuuuccgggggagcagcuccuguucuuuagaucuacaaugcccggauguuccggcuacccuaacaugaaccuggauugccugcucccccaagaaugggugcagcauuucuaucaggaggccgcgccugcucagagcgacguggcccugcuucgguuuguuaaucccgauaccgggcgcguccuguucgaguguaagcuccacaaaucuggauacgugacaguggcccacaccggcccuuaugaccuggucauucccccgaacggguacuuuagauucgauagcugggugaaucaauuuuauacgcuugcuccuaugggcaacggagccggccggagacgcuga

SEQ ID NO: 30329 - RNA, 1614 nt, Artificial Sequence
  derived and/or modified sequence opt5 from VP1__Norovirus_and/or_Norovirus-like__KX514279
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaaccccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaauagcagauuucccauuaaccuugaacggcuguucaccggaccgucuuccgccaaugucgugcagccucagaacggccgcuguacaaucgauggggagcuccugggaaccacgcaacugagcucuguuaauaucugcacauucagaggcgacgugacccagauuggcuccacacaucacuggaccaugaaccucgccagccccaauuggaacaauuacgauccuaccgaggaaacacccgcuccucuggggacgcccgacuuugucggaaagauccauggcaugcuuacccagacaacccaggagaacggguccacacgggcgcaccgcgccaccguguaugucggaucugcugacuucacgccgaaacugggcaaggugcaauuugaaacagauaccgaggacgaucucgccauuagacagaauaccaaguucacaccuguuggggugauccagagcuccgaccaccaucgggaugaaccccaacaguggcgccugcccaacuacagcggagccaauaccuuuaacguccaccuugcuccugccguggcgccgaauuuccccggcgagcagcugcucuuuuucagaucuacacugccuggcugugggggacaucccaacauggaccuggauugccuccugccucaggaguggguucaacacuuuuaccaggaagcugcccccgcccaguccgacguggcccuucugcgguucgucaacccugauacgagcagagugcucuuugaguguaaacugcacaagucuggcuaugugaccguugcucauacagggcaguacgaccuuguccugcccagcaauggauauuuccgcuuugauuccugggugaaccaauucuacacccucgcuccgaugggcaaugggacaggccggagacgcuga

SEQ ID NO: 30330 - RNA, 1614 nt, Artificial Sequence
  derived and/or modified sequence opt5 from VP1__Norovirus_and/or_Norovirus-like__LC016602
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcaccuccacauacagaaugaaccucgccagccagaauuggaacaauuaugauccuacggaggaaauucccgcuccucugggcacccccgacuucguggggaaaauccagggaaugcuuacacagaccacaaagggcgacggguccacccggggacacaaggcgacggucucuacaggcagcguggauuuuaccccgaaacugggguccguucaauucgacaccgauacaaacaaugaccucgagaccggacagaacacacgcuuuacgccugugggcgucauucaggauggcagcgcccauagaaaugaaccccaacagugggugcugcccgacuacucugggcggaccguucacaacgugcaccuugcuccugccgucgccccgacauuccccggagagcagcugcucuuuuuccgcuccaccaugccuggcuguagcggguaccccaauauggaucuggacugccugcucccucaggaaugggugcaacauuuuuaucaggaggcugcccccgcgcagucugauguggcucugcuuagauucguuaacccugacacaggacggguccuguuugaguguaagcuccacaaaaccggcuacgugacgguggcccauaccgggcagcacgaucuggucauucccccgaauggcuauuucagauuugacagcugggugaaccaauucuacacacuugccccuaugggaaacggcgcugggcgccggagauga

SEQ ID NO: 30331 - RNA, 1614 nt, Artificial Sequence
  derived and/or modified sequence opt5 from VP1__Norovirus_and/or_Norovirus-like__AF145896
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacaucaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccagucccaugacagcacacucaagcugauugcuaugcuuuauacaccccugcgcgccaauaacgcuggcgaugacguuuucaccgugucuugcagagugcucacccggcccuccccugauuuugacuucaucuuucuggucccgcccacaguggaaagccgcaccaaaccuuucacgguucccauucuuaccguggaggaaaugucuaacuccagauuuccuaucccccuggagaagcucuacacagggccgagcucugccuucgucgugcagccucagaauggacgguguaccacagauggcguucugcuggggaccacgcaacucuccgccgugaacauuugcaauuuccgcggagacgucacacacaucgugggcagccaugauuauaccaugaaccuggcuucccagaauuggucuaacuacgaccccacagaggaaaucccugcgccccuuggcaccccugacuuugucgggaaaauucagggacugcucacccagacaacgagagccgauggcagcacccgggcucacaaggccacaguguccaccgggagcguucacuucacacccaagcugggaucugugcaauuuaccacggacacaaauaacgauuuccagaccggccagaauaccaaauuuacaccggucggggugauccaagacggagaucaucaccagaacgagccucagcaguggguucuucccaauuacuccggccgcaccggccauaacgugcaccuggcccccgcugucgccccuacauucccgggggaacaacuccuguuuuucagaagcacgaugcccggauguucuggcuauccuaauaugaaccuggacugccuccugccccaggagugggugcuucacuuuuaccaggaagcggcuccugcccagagcgauguggcccugcuccgguucguuaaucccgacaccgggcgcguccuguuugaguguaaacuucauaaguccggauauauuacaguggcucacaccggcccuuucgaucuggugauucccccgaacggguacuuuagauucgacucuugggucaaccaauucuauacacucgccccuaugggcaauggaaccggccggagacgcuga

SEQ ID NO: 30332 - RNA, 1614 nt, Artificial Sequence
  derived and/or modified sequence opt5 from VP1__Norovirus_and/or_Norovirus-like__AB684704
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacauuaucgacccuuggauuagaaauaacuucgugcaggcccccggcggggaauuuaccguuuccccucggaaugcgcccggagagauccuguggucugccccucuuagcccggaucugaaccccuaccucucccaccugucucgcauguauaauggcuacgcugggggauucgaagugcaggucauucuugccggcaacgcuuuuacagccggcaaagugaucuucgcggccguuccucccaauuuuccuacggaggggcugagccccucccaggugaccauguucccgcauaucauugucgacgugagacaacucgagccugugcugaucccccugccugauguccggaacaauuuuuaucacuacaaccaggcucaugacagcacacucaagcugauugccaugcuuuauacaccccugcgcgcuaauaacgccggagaugacguuuucaccgugucuugcagagugcucacccggcccuccccugauuuugacuucaucuuucuggucccgcccacaguggaaagccgcaccaaaccuuucacgguucccauucuuaccguggaggaaaugucuaacuccaaguuuccuaucccccuggagaaacucuacacaggcccgagcucugccuucgucgugcagccucagaaugggagauguaccacagauggaguucugcugggcaccacgcaacucuccgcugugaacauuugcaauuuccgcggggacgucacacgggugggaaccagccacgauuauacaaugaaccuggucucccagaauuggaacaauuacgaccccaccgaggaaaucccugcgccccuuggcaccccugacuuugugggcaagauccaggggcugcucacacagacgaccagagccgauggaucuacacgggcucauaaggccaccguuagcacaggcuccgugcacuucacccccaaacuggggagcguccaauuuacgacagacaccaacaaugauuucgagaccggacagaacacaaaguuuaccccggugggcguuauucaggacggggaucaccaucaaaaugaaccucagcagugggugcuucccucuuacuccggaagcucuggccacaacguccaucuggcccccgcuguggccccuacauucccgggcgagcagcuccuguuuuuccgcagcacgaugcccggguguuccggauauccuaauaugaaccuggacugccuccugccccaagaaugggugcuucacuuuuaccaggaggcggcuccugcccagucugauguugcccugcucagauucgucaaucccgacaccggccgggugcuguuugaguguaaacuucacaagagcggguauaucacaguggcucauaccggaccuuacgaucuggucauucccccgaacggcuauuuccgcuuugacuccugggugaaccaguucuacacacucgccccuauggggaauggcaccggaagacggagauga

SEQ ID NO: 30333 - RNA, 1614 nt, Artificial Sequence
  derived and/or modified sequence opt5 from VP1__Norovirus_and/or_Norovirus-like__JX401279
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacauuaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccaggcucaugacuccacacucaagcugauugccaugcuuuauacaccccugcgcgcuaauaacgccggcgaugacguuuucaccgugagcugcagagugcucacccggcccucuccugauuuugacuucaucuuucuggucccgcccacaguggaaucccgcaccaaaccuuucacgguucccauucuuaccguggaggaaaugagcaacucuagauuuccuaucccccuggagaagcucuacacagggccguccagcgccuucgucgugcagccucagaauggacgguguaccacagauggcguucugcuggggaccacgcaacucucugcugugaacauuugcaauuuccgcggagacgucacaagagugggcaccucccacgauuauacaaugaaccuggucagccagaauuggaacaauuacgaccccaccgaggaaaucccugcgccccuuggcaccccugacuuuguggggaaaauccagggacugcucacacagacgacccgggccgauggcuccacacgcgcucauaaggccaccguuucuacagggagcgugcacuucacccccaagcugggauccguccaauuuacgacagacaccgauaacgacuuccagaccggccagaauacaaaauuuaccccgguggggguuauucaagauggagaccaccaucagaacgagccucagcagugggugcuucccaauuacagcggcacaucuggccacaacguccaucuggcccccgcuguggccccugcguucccgggggaacaacuccuguuuuucagauccacgaugcccggauguagcggcuauccuaauaugaaccuggauugccuccugccccaggagugggugcuucacuuuuaccaggaagcugccccugcccagucugacguugcucugcuccgguucgucaaucccgauaccgggcgcgugcuguuugaguguaaacuucacaagagcggauauaucacaguggcccauaccggcccuuacgaccuggucauucccccgaacggguauuucagauuugauuccugggugaaccaauucuacacacucgcuccuaugggcaauggaaccggccggagacgcuga

SEQ ID NO: 30334 - RNA, 1614 nt, Artificial Sequence
  derived and/or modified sequence opt5 from VP1__Norovirus_and/or_Norovirus-like__GQ389627
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauaucgcuggcucucacgauuauaccaugaaucucgcgucccagaacuggagcaauuacgaccccaccgaggaaauuccugcuccccugggcacaccugacuuuguggggaaaauccagggaaugcuuacgcagaccacaagagaggauggcuccacccgggcccauaaggccacagucucuaccgggagcgugcacuucacgcccaagcugggauccguucaauacacaaccgacaccaacaaugauuuucagacaggccagaacaccaaauucacaccggugggggucauucaagacggaaauaaccaccagaaugaaccucagcagugggugcuccccaacuauagcggccgcacgggccauaauguucaccuggcccccgcuguggccccuaccuuuccgggggagcaacuucuguucuuuagaucuacaaugcccggauguuccggcuacccuaacaugaaccucgauugccugcugccccaggaauggguccagcauuucugucaggaggcggcuccugcccaaagcgacguggcccuccugcgguuugugaaucccgauaccgggcgcguucuuuucgagugcaagcugcacaaaucuggauaugucacaguggcucacaccggcccucaugaccucgugauucccccgaacggguacuuuagauucgauagcugggucaaucaguuuuauacgcuggccccuaugggcaacggagcuggccggagacgcuga

SEQ ID NO: 30335 - RNA, 1614 nt, Artificial Sequence
  derived and/or modified sequence opt5 from VP1__Norovirus_and/or_Norovirus-like__AF425763
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcuccccggggcgaauuuacagugagcccucgcaacgcccccggggagauucugugguccgcgccucuuggaccggaucugaaucccuaccucucucaccuggccagaauguauaacggcuacgcugggggauucgaaguccaggugauccuugccggcaaugcuuuuacggccggcaaaauuaucuucgcggccguuccucccaacuuuccuaccgaggggcugagccccucccaggugacaauguucccgcauaucauugucgacgugcggcaacucgagccugugcugaucccccugccugauguccgcaauaacuuuuaucacuacaaucagucuaacgacagcaccauuaagcucaucgcuaugcccuauacaccccugagagccaacaaugcuggagaugacguuuucaccguguccugccgggugcuuacacgcccuagcccggauuuugacuucauuuuucuggugcccccuaccgucgaaucuagaacgaaacccuucaccguuccuauccucacaguggaggaaauguccaacagccgguuucccauuccgcuggagaaacuuuacaccggcccuucuuccgccuucgucgugcagccccagaaugggcgcuguacaaccgauggaguucugcucggcacgacacaacugagcgccgugaacaucugcaccuucagaggggacgucacacauaucgcuggaucucacgauuauaccaugaaucuggcgucccagaacuggaauaacuacgacccuaccgaggaaauucccgccccucucggcacacccgacuuugugggcaagauccaggggaugcugacgcagaccacacgggaggauggaagcacccgcgcucauaaggccacagucuccaccggcucugugcacuucacgccgagacuugggagcguucaauacacaaccgacaccaauaacgauuuucagacaggacagaauaccaaguucacaccugugggcgucauucaagacgggaacaaucaccagaacgaaccccagcagugggugcugcccaauuauuccggacggacgggccauaacguucaccucgccccugcuguggccccgaccuuucccggcgagcaacugcuuuucuuucgcagcacaaugccuggguguucuggauaccccaacaugaaucuggauugccuccugccucaggaauggguccagcauuucuaucaggaggcggcucccgcccaauccgacguggcccugcucagauuugugaacccugauaccggccggguucuguucgaguguaaacuucacaagagcggguacgucacaguggcucacaccggaccccaugaccuggugaucccgccuaauggcuauuuuagauucgauucuugggucaaccaguuuuacacgcucgcccccauggggaauggcgcuggacgccggagauga

SEQ ID NO: 30336 - RNA, 1614 nt, Artificial Sequence
  derived and/or modified sequence opt5 from VP1__Norovirus_and/or_Norovirus-like__AY532127
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauggccggaauaacuuuuaucacuacaaucagucuaacgacagcaccauuaagcucaucgcuaugcuguauacaccccuucgcgccaacaaugcuggggaugacgucuucaccguuuccugcagagugcugacacggcccagcccugauuuugacuucauuuuucucgugccgcccaccgucgaaucucgcacgaaaccuuucaccgugcccauccugacaguugaggaaauguccaacagcagauuuccuauuccccuugagaagcuguacaccggaccgucuuccgccuucgugguccagccucagaauggccgguguacaaccgauggggugcuccugggaacgacacaacugagcgccguuaacaucugcaccuuccgcggcgacgugacacauaucgcuggcucucacgauuauaccaugaaucucgcgucccagaacuggaauaacuacgaccccaccgaggaaauuccugcuccccuggggacaccugacuuugucggaaaaauccagggcacgcuuacccagacaaccagagaggaugggagcacacgggcccauaaggccaccguguccacgggaucuguccacuucacacccaagcugggcagcgcccaauacaccaccgacacaaauaacgauuuucagaccgggcagaauacaaaauucacgccggugggaguuauucaagacggcaacaaucaccagaacgaaccucagcagugggugcuccccaauuauuccggccgcaccgggcauaacguccaccuggcucccgccguggcgccuacauuuccgggagagcaacuucuguucuuuagaagcaccaugcccggcuguucuggguacccuaacaugaaucucgauugccugcugccccaggaauggguucagcauuucuaucaggaggcugccccugcccaauccgacguggcucuccugcgguuugucaaccccgauacaggacgcgugcuuuucgaguguaagcugcacaaaagcggcuacgugaccguugcccacacggggccucaugaccucgucauucccccgaauggcuauuuuagauucgauucuugggugaaccaguuuuacacccuggcuccuaugggaaauggcgccgggcggagacgcuga

SEQ ID NO: 30337 - RNA, 1614 nt, Artificial Sequence
  derived and/or modified sequence opt5 from VP1__Norovirus_and/or_Norovirus-like__AY532118
augaagauggccagcaacgacgcuaaucccuccgauggcucuaccgccaaccuggugccugaggucaauaacgaaguuauggcgcucgagccgguggugggggcugccaucgccgcucccgucgccggacagcaaaauaucaucgacccuuggauuagaaacaauuucgugcaggcucccggcggggaauuuacaguuagcccucggaacgcccccggagagauccugugguccgcgccucuuggcccggaucugaaucccuaccucucucaccuggcccgcauguauaacggguacgcuggaggcuucgaagugcaggucauucuugccggcaaugcuuuuacggccgggaaaaucaucuucgcggccgugccucccaacuuuccuaccgagggacugggccccagccagguuacaauguucccgcauauuaucguggacgucagacaacucgagccugugcugauuccccugccugaugugcggaauaacuuuuaucacuacaaucaguccaacgacucuaccaucaagcucauugcuaugcuguauacaccccuucgcgccaacaaugcuggggaugacgucuucaccguuagcugcagagugcugacacggcccuccccugauuuugacuucaucuuucucgugccgcccaccgucgaaagccgcacgaaaccuuucaccgugcccauucugacaguugaggaaaugucuaacuccagauuuccugugccccuugagaagcuguacaccggaccgagcucugccuucgucgugcagccucagaauggccgguguacaaccgaugggguucuccugggaacgacacaacuguccgccgugaacaucugcaccuuccgcggcgacgucacacauaucgcuggcagcagagauuauaccaugaaucucgcgucucagaacuggaauaacuacgaccccaccgaggaaauuccugcuccccuggggacaccugacuuugugggaaaaauccagggcguccuuacgcagaccacacgggaggauggguccacccgcgcccacaaggccacagugagcaccggauccguucauuucacgcccaagcugggcucugugcaauacacaaccgacaccgauaaugacuuucagacagggcagaacaccaaauucacaccggucggagugauucaagauggcaauaaccaccagaaugaaccucagcaguggguucuccccaacuauagcggcagacccgggcacaaugugcaucuggccccugcugucgccccgacguuucuuggagagcaacuccuguucuuucgguccaccaugcccggcuguagcggguacccuaacaugaaccuggacugccugcucccccaggaaugggugcagcacuucuaucaggaggcggcuccugcccaaucugauguggcccugcuucgcuuuguuaaucccgacacaggaagaguccuguucgaguguaagcuccauaaauccggcuacgugaccguggcucacacagggccucacgaucuggucauucccccgaacggcuauuuucgguucgacagcugggugaaucaguuuuacacccuugccccuaugggaaacggcgcugggagacgccgguga

SEQ ID NO: 30338 - RNA, 1614 nt, Artificial Sequence
  derived and/or modified sequence opt5 from VP1__Norovirus_and/or_Norovirus-like__KX514326
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaucccggcgaugacguuuucaccguguccugcagagugcugacccggccuagcccggauuuugacuucauuuuucucgugcccccuacagucgaaucucgcaccaaacccuucuccguuccuauccugacggugggggagaugaccaacagcagauuucccauuaaucuugaacggcuguucacaggaccgucuuccgccaacgucgugcagccucagaauggccgcuguaccaucgauggggagcuccugggaacaacccaacugagcucuguuaacaucugcacguucagaggcgacgugacacagauuggcuccaccaagcauuggacaaugaaucucgccagccccaacuggaauaacuacgauccuaccgaggaaacccccgcuccucuggggacacccgacuuugucggaaaaauccacggcaugcuuacgcagaccacacaggagaauggguccacccgggcgcaucgcgccacaguguaugucggaggcgcuaacuucaccccgaagcuggggaaggugcaauuugaaacggacacaguugaugaccucgagauuagacagaauaccaaauucaccccugugggagucauccagucuagcgaucaccaccgggacgaaccccaacaguggcgccugcccaacuacuccggcgccaauacauuuaacgugcaucuugccccugcuguugccccgaacuuccccggcgagcagcugcucuuuuucagaagcacccugccuggguguggaggccaccccaauauggaucuggacugccuccugccucaggagugggugcaacauuuuuaccaggaagcggcucccgcccagucugaugucgcccuucugcgguucgugaacccugacacauccagagugcucuuugaguguaagcugcacaaaagcggguauguuacggucgcucacaccggacaguacgaucuugugcugcccucuaauggcuauuuccgcuuugacagcugggugaaccaauucuacacacucgccccgauggggaauggcaccggacggagacgcuga

SEQ ID NO: 30339 - RNA, 1614 nt, Artificial Sequence
  derived and/or modified sequence opt5 from VP1__Norovirus_and/or_Norovirus-like__KX514264
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaucccggcgaugacguuuucaccguguccugcagagugcugacccggccuagcccggauuuugacuucauuuuucucgugcccccuacagucgaaucucgcaccaaacccuucuccguuccuauccugacggugggggagaugaccaacagcagauuucccgucaaucuugaacggcuguucacaggaccgucuuccgccaacgugguucagccucagaauggccgcuguaccauugauggggagcuccugggaacaacccaacugagcucugugaacaucugcacguucagaggcgacgucacacauaucggcuccacccaccauuggacaaugaaucucgccagccccaacuggaauaacuacgauccuaccgaggaaacccccgcuccucuggggacacccgacuuugugggaaagauucacggcaugcuuacgcagaccacacagggguccggaucuacccgggcgcaccgcgccacagucuaugugggcagcgcugaguucaccccgaaacuggggaagguucaguuucaaacggaaacagaggacgaucucgugaucagacagaauaccaaguucaccccugucggagugauucaggaauccgaccaucaccgggaugagccccaacaguggcgccugcccaacuacagcggcgccaauacauuuaacguucaucuugccccugcuguggccccgaauuuccccggcgagcagcugcucuuuuucagaucuaccaucccuggguguggaggccaccccaacaugaaccuggacugccugcucccucaggaauggguccaacacuuuuaccaggaggcggcucccgcccaguccgauguggcccugcuucgguucgugaauccugacacaagcagaguucuguuugaauguaaacuccauaagucuggguaugucacgguggcucacaccggacagcaugaucuggugauucccccgaacggcuacuuccgcuuugacagcugggucaaucaauucuauacacuugccccuauggggaacggcaccggacggaaaagauga

SEQ ID NO: 30340 - RNA, 1614 nt, Artificial Sequence
  derived and/or modified sequence opt5 from VP1__Norovirus_and/or_Norovirus-like__KX514171
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaaccccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaauagcagauuucccgucaaccuugaacggcuguucaccggaccgucuuccgccaaugugguucagccucagaacggccgcuguacaauugauggggagcuccugggaaccacgcaacugagcucugugaauaucugcacauucagaggcgacgucacccauaucggcacaacccagcacuggaccaugaaccucgccucccccaauuggaacaauuacgauccuacagaggaaacgcccgcuccucuggggacccccgacuuugugggaaagauucauggcaugcuuacacagaccacacaggggagcggauccacccgggcgcaccgcgccacggucuaugugggcucugcugaguucacaccgaaacuggggaagguuagauuugaaaccgacaccgaggaugaccucgugauccggcaaaacacaaaguucaccccugucggagugauucagagcuccgaacaccaucgcgaugagccccagcaauggagacugcccaauuacagcggcgccaacacauuuaauguucaccuugccccugcuguggccccgaacuuccccggcgagcagcugcucuuuuuccggucuacgcugccuggguguggaggccaucccaauauggaccuggauugccuccugccucaggaauggguccagcacuuuuaccaagaggcggcucccgcccaguccgacguggcccuucugagauucgugaacccugauaccagccgcguucucuuugaauguaaacugcacaagucuggguaugucacaguggcucauaccggacaguacgaccuugugcugcccagcaacggcuauuuccgguuugauuccugggucaaucaguucuacacacucgccccgauggggaacggcaccggaagacgccgguga

SEQ ID NO: 30341 - RNA, 1614 nt, Artificial Sequence
  derived and/or modified sequence opt5 from VP1__Norovirus_and/or_Norovirus-like__KX514170
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaaccccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaauagcagauuucccgucaaccuugaacggcuguucaccggaccgucuuccgccaaugugguucagccucagaacggccgcuguacaauugauggggagcuccugggaaccacgcaacugagcucugugaauaucugcacauucagaggcgacgucacccauaucggcacaacccagcacuggauuaugaaccucgccucccccaauuggaacaauuacgauccuaccgaggaaacacccgcuccucuggggacgcccgacuuugugggaaagauccauggcaugcuuacccagacaacccaggggagcggauccacacgggcgcaccgcgccaccgucuaugugggcucugcugaguucacgccgaaacuggggaagguuagauuugaaacagacaccgaggaugaccucgugauucggcaaaacaccaaguucacaccugucggagugauccagagcuccgaacaccaucgcgaugagccccagcaauggagacugcccaauuacagcggcgccaacaccuuuaauguucaccuugccccugcuguggccccgaacuuccccggcgagcagcugcucuuuuuccggucuacacugccuggguguggaggccaucccaauauggaccuggauugccuccugccucaggaauggguccagcacuuuuaccaagaggcggcucccgcccaguccgacguggcccuucugagauucgugaacccugauacgagccgcguucucuuugaauguaaacugcacaagucuggguaugucaccguggcucauacaggacaguacgaccuugugcugcccagcaacggcuauuuccgguuugauuccugggucaaucaguucuacacccucgccccgauggggaacggcacaggaagacgccgguga

SEQ ID NO: 30342 - RNA, 1614 nt, Artificial Sequence
  derived and/or modified sequence opt5 from VP1__Norovirus_and/or_Norovirus-like__KF806533
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuuccgccuucgugguucagccccagaauggacgguguaccacagacggcgugcuccuggggaccacgcaacugagcccugucaacauuugcacauuucgcggagaucucacccauuucgcuggcacacacgaauacgcgaugaaucuggccucucagaacuggaccaauuaugaccccaccgaggaaaucccugcuccccuuggcgccccggauuuuguggggaagaucagaggaguccugacacagacgacccggggcgacggguccacacgcggacauagagccacccucagcacaggcuccgcucacuucaccccuaagcuggggucugugcgguuuagcacggacacaaacaaugauuucgaggccggacagaacaccaaauuuacccccguuggcguguuccaagacggcgauaaucaccagaacgaaccccagcaauggguccuuccuaauuacuccggggcgacagcucauaacgugcaccuggccccggccguugcucccgccuuuccuggagagcagcuccuguucuuucgcagcaccaugcccggcuguucuggguacccuaauaugaaccuggacugccuccugccccaggagugggugcagcauuucuaucaagaagcugccccugcgcaguccgaugucgcccuucugagauuugugaaucccgacacaagccggguucucuucgaguguaagcugcacaaaucuggauacgugacggucgcucacaccggccagcaugaucuugugauuccgccuaacggguauuucagauuugacagcugggugaaccaguucuacacacuggcccccaugggcaauggaaccggccgccggagauga

SEQ ID NO: 30343 - RNA, 1614 nt, Artificial Sequence
  derived and/or modified sequence opt5 from VP1__Norovirus_and/or_Norovirus-like__KF806528
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccugggaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacaggcccuucuggggccuucgugguucagccccagaauggacgguguaccacagacggcgugcuccuggggaccacgcaacuguccccugucaacauuugcacauuucgcggagaucucacccauuucgcuggcacacacgaauacgcgaugaaucuggccagccagaacuggaauaacuaugaccccaccgaggaaaucccugcuccccuuggcgccccggauuuuguggggaagaucagaggaguccugacccagacaacgcggcgcgacggcucuaccagagggcaucgggccacacucuccaccggaagcgcucacuucacaccuaagcugggcuccauucgcuuuucuaccgacacgaauaacgauuucgaggccgggcagaauacaaaauuuacccccgugggaguuuuccaagacggcgauaaccaccagaaugaaccccagcaaugggugcuuccuaacuacagcggcgcgaccgcucauaauguccaccuggccccggccguggcucccgccuuuccuggggagcagcuccuguucuuuagauccacaaugcccggauguagcggcuacccuaacaugaaucuggacugccuccugccccaggaguggguucagcauuucuaucaagaagcugccccugcgcagucugauguggcccuucugcgguuugucaaccccgacaccuccagaguucucuucgaguguaagcugcacaaaagcggguacgugacaguggcucacacgggacagcaugaucuugucaucccgccuaacggcuauuuccgcuuugacucuugggugaaucaguucuacacccuggcccccauggggaacggcacaggacggagacgcuga

SEQ ID NO: 30344 - RNA, 1614 nt, Artificial Sequence
  derived and/or modified sequence opt5 from VP1__Norovirus_and/or_Norovirus-like__KF806527
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuuccgccuucgugguucagccccagaauggacgguguaccacagacggcgugcuccuggggaccacgcaacugagcccugucaacauuugcacauuucgcggagaucucacccauuucgcuggcacaucugaauacgcgaugaaucuggccucccagaacuggaccaauuaugaccccaccgaggaaaucccugcuccccuuggcgccccggauuuuguggggaagaucagaggaguccugacacagacgacccggggcgacgggagcacacgcggacacagagccacccucuccacaggcucugcucauuucaccccuaagcuggggagcgugcgguuuuccacggacacaaacaaugauuucgaggccggacagaacaccaaauuuacccccguuggcguguuccaagacggcgauaaucaccagaacgaaccccagcaauggguccuuccuaauuacagcggggcgacagcucacaacgugcaucuggccccggccguugcucccgccuuuccuggagagcagcuccuguucuuucgcucuaccaugcccggcuguuccggguacccuaauaugaaccuggacugccuccugccccaggagugggugcagcacuucuaucaagaagcugccccugcgcagagcgaugucgcccuucugagauuugugaaucccgacacaucucggguucucuucgaguguaagcugcauaaaagcggauacgugacggucgcucacaccggccagcacgaucuugugauuccgccuaacggguauuucagauuugacuccugggugaaccaguucuacacacuggcccccaugggcaauggaaccggccgccggagauga

SEQ ID NO: 30345 - RNA, 1614 nt, Artificial Sequence
  derived and/or modified sequence opt5 from VP1__Norovirus_and/or_Norovirus-like__KX514261
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccgucaaucuugaacggcuguucaccggaccguccagcgccaacgugguucagccucagaauggccgcuguacaauugauggggagcuccugggaaccacgcaacugucuuccgugaacaucugcacauucagaggcgacgucacccauaucggcagcacacaccauuggaccaugaaucucgccucccccaacuggaauaacuacgauccuaccgaggaaacacccgcuccucuggggacgcccgacuuugugggaaagauucacggcaugcuuacccagacaacccaggggucuggaagcacacgggcgcaccgcgccaccgucuaugugggcuccgcugaguucacgccgaaacuggggaagguucaguuucaaacagaaaccgaggacgaucucgugaucagacagaauaccaaguucacaccugucggagugauucaggaaagcgaccaucaccgggaugagccccaacaguggcgccugcccaacuacucuggcgccaauaccuuuaacguucaucuugccccugcuguggccccgaauuuccccggcgagcagcugcucuuuuucagauccacacugccuggguguggaggccaccccaacauggaccuggauugccuccugccucaggaauggguccaacacuuuuaccaggaggcggcucccgcccagagcgacguggcccuucugcgguucgugaauccugauacgucuagaguucucuuugaauguaaacugcauaagagcggguaugucaccguggcucacacaggacaguacgaccuugugcugcccuccaacggcuauuuccgcuuugauucuugggucaaccaauucuacacccucgccccgauggggaauggcacaggacggagacgcuga

SEQ ID NO: 30346 - RNA, 1614 nt, Artificial Sequence
  derived and/or modified sequence opt5 from VP1__Norovirus_and/or_Norovirus-like__AB684720
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccugucccgcauguauaauggguacgccggaggcuucgaaguccaggugauccuugcuggcaacgccuuuacggcugggaaaauuaucuucgccgcgguuccucccaauuuuccuaccgagggacugucucccagccaggugacaauguucccgcauaucauugucgacgugagacaacucgagccugugcugaucccccugccugauguccggaacaauuuuuaucacuacaaccaggcccaugacuccacccucaagcugauugcuaugcuuuauacaccccugcgcgccaauaacgcuggcgaugacguuuucaccgugagcugcagagugcucacacggcccucuccugauuuugacuucaucuuucuggucccgcccaccguggaaucccgcacgaaaccuuucagcguucccauucuuaccguggaggaaaugucuaacuccagauuuccuaucccccuggagaagcucuacacagggccgagcucugccuucgucgugcagccucagaauggacgguguaccacagauggcguucugcuggggaccacgcaacucuccgccgugaacauuugcaauuuccgcggagacgucacacacaucagaggcagccgggauuauaccaugaaccuggugucccagaauuggaacaauuacgaccccacagaggaaaucccugcuccccuuggcaccccugacuuugucgggaaaauucagggacugcucacccagacaacgcgcgcggauggcucuaccagagcccauaaggcuacagugagcaccggguccguucacuucacacccaagcugggaagcgugcaauuuaccacggacacagauaacgacuuccagaccggccagaauaccaaauuuacaccggucggggugauccaagauucugaccaccaucagaacgagccucagcaguggguucuucccaauuacuccggagccagcggccacaacgugcaucuggcccccgcugucgccccuaccuucccgggcgaacaacuccuguuuuuccggucuacaaugcccggguguagcggauauccuaauaugaaccuggauugccuccugccccaggagugggugcuucacuuuuaccaggaagcggcuccugcccaguccgacguggcccugcuccgcuucguuaaucccgauacgggcagaguccuguuugaguguaaacuucacaagucuggguauauuaccguggcucauacaggaccuuacgaccuggugauucccccgaacggcuauuuccgguuugauagcugggucaaccaauucuacacccucgccccuauggggaauggcacaggaagacgccgguga

SEQ ID NO: 30347 - RNA, 1614 nt, Artificial Sequence
  derived and/or modified sequence opt5 from VP1__Norovirus_and/or_Norovirus-like__LC016605
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucagaucacaauguucccgcauauuaucguggacgucagacaacucgagccugugcugauuccccugccugaugugcggaacaauuuuuaucacuacaaccagagcaaugacuccaccaucaagcucauugcuaugcuguauacaccccuucgcgccaacaacgcuggcgaugacgucuucaccguuagcugcagagugcugacacggcccucuccugauuuugacuucaucuuucucgugccgcccaccgucgaaucccgcacgaaaccuuucaccgugcccauucugacaguugaggaaaugaccaauagcagauuuccuaucccccuugagaagcuguucacagggccgucuuccgccuucgugguccagccucagaacggacgguguaccacggauggcgugcuccuggggacaacccaacugagccccguuaauaucugcacauuucgcggagacgugacccauauuccuggcaccagaacauaccggaugaaccucgccucucagaauuggaacaauuaugaucccacggaggaaaucccugcuccccugggcaccccggacuucgucgggaaaauucagggaaugcuuacacagaccacaaagggcgacggguccacccgcggacacaaggcgacggugagcacaggcuccgucgauuuuaccccuaaacuggggucugugcaauucgacaccgauacaaacaaugaccucgagaccggacagaacacaagauuuacgcccguuggcgugauccaggauggcagcgcccaucggaaugaaccccaacaguggguccugccugacuacuccgggcgcaccgugcacaacguucaccuugcuccggccguggcccccacauucccuggagagcagcugcucuuuuucagaagcaccaugcccggcuguucuggguacccuaauauggaucuggacugccugcucccccaggaauggguccaacauuuuuaucaggaggcugccccugcgcaguccgauguggcucugcuucgguucgugaaccccgacacaggaagaguucuguuugaguguaagcuccacaaaaccggcuacgucacgguggcccauaccgggcagcacgaucuggugauuccgccuaauggcuauuuccgcuuugacagcugggucaaccaauucuacacacuugcccccaugggaaacggcgcugggcggagacgcuga

SEQ ID NO: 30348 - RNA, 1614 nt, Artificial Sequence
  derived and/or modified sequence opt5 from VP1__Norovirus_and/or_Norovirus-like__KF806529
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuggagccuucgugguucagccccagaauggccgguguaccacagacggggugcuccugggaaccacgcaacuguccccugucaacauuugcacauuucgcggcgaucucacccauuucgcuggcacacacgaauacgcgaugaaucuggccagccagaacuggucuaauuaugaccccaccgaggaaaucccugcuccccuuggggccccggauuuugugggaaagaucagaggcguccugacccagacaacgcgcggggacggauccacccggggccauagagccacacucagcaccggguccgcucacuucacaccuaagcugggaucuauucgguuuagcaccgacacgaacaaugauuucgaggccggccagaacacaaaauuuacccccgugggcguuuuccaagacggggauaaucaccagaacgaaccccagcaaugggugcuuccuaauuacuccggagcgaccgcucauaacguccaccuggccccggccguggcucccgccuuuccuggcgagcagcuccuguucuuucgcagcacaaugcccggguguucuggauacccugacaugaaucuggauugccuccugccccaggaguggguucagcauuucuaucaagaagcugccccugcgcaguccgacguggcccuucugagauuugucaaccccgauaccagccggguucucuucgaguguaagcugcacaaaucuggcuacgugacaguggcucacacggggcagcaugaccuugucaucccgccuaauggcuauuucagauuugauagcugggugaaccaguucuacacccuggcccccaugggaaacggcacagggcgccggagauga

SEQ ID NO: 30349 - RNA, 1614 nt, Artificial Sequence
  derived and/or modified sequence opt5 from VP1__Norovirus_and/or_Norovirus-like__JX023286
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacaucaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccaggcucaugacuccacacucaagcugauugccaugcuuuauacaccccugcgcgcuaauaacgccggcgaugacguuuucaccgugagcugcagagugcucacccggcccucuccugauuuugacuucaucuuucuggucccgcccacaguggaaucccgcaccaaaccuuucacgguucccauucuuaccguggaggaaaugagcaacucuagauuuccuaucccccuggagaagcucuacacagggccguccagcgccuucgucgugcagccucagaauggacgguguaccacagauggcguucugcuggggaccacgcaacucucugcugugaacauuugcaauuuccgcggagacgucacaagagugggcaucucccacgauuauaccaugaaccuggucagccagaauuggaacaauuacgaccccacagaggaaaucccugcgccccuuggcaccccugacuuuguggggaaaauucagggacugcucacccagacaacgcgggccgauggcuccacccgcgcucauaaggccacaguuucuaccgggagcgugcacuucacacccaagcugggauccguccaauuuaccacggacacaaacaaugauuuccagaccggccagaacaccaaauuuacaccgguggggguuauccaagacggagaucaccaucagaaugagccucagcagugggugcuucccaacuacagcggcaccucuggccacaauguccaucuggcccccgcuguggccccuacauucccgggggaacaacuccuguuuuucagauccacgaugcccggauguagcggcuauccuaacaugaaucuggacugccuccugccccaggagugggugcuucacuuuuaccaggaagcggcuccugcccagucugauguugcccugcuccgguucgucaaccccgacaccgggcgcgugcuguuugaguguaaacuucacaagagcggauauauuacaguggcucauaccggcccuuacgaucuggucauucccccgaacggguauuucagauuugacuccugggugaaucaauucuacacacucgccccuaugggcaacggaaccggccggagacgcuga

SEQ ID NO: 30350 - RNA, 1614 nt, Artificial Sequence
  derived and/or modified sequence opt5 from VP1__Norovirus_and/or_Norovirus-like__FJ537137
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccugagccgcauguauaacggguacgcuggaggcuucgaaguccaggugauccuugccggcaaugcuuuuacagccgggaaaguuauuuucgcggccgugccucccaacuuuccuacggagggacugucccccucucaggucaccauguucccgcauaucaucguggacgugagacaacucgagccuguccugauuccccugccugauguucggaauaacuuuuaucacuacaaucaggcucaugacagcacacucaagcugaucgccaugcuuuauacaccccugcgcgcuaacaacgccggcgaugacguguucaccguguccugcagaguccucacccggcccagcccugauuuugacuucauuuuucuggugccgcccacaguugaaucucgcaccaaaccuuucacggugcccauccuuaccgucgaggaaauguccaauagcagauuuccuauuccccuggagaagcucuacacagggccgucuuccgccuucgugguucagccucagaacggacgguguaccacagauggcgugcugcuggggaccacgcaacucagcgcugucaauaucugcaacuuccgcggagacgugacacacauugucggcucucaugauuauaccaugaaucuggugucccagaacuggagcaauuacgaccccacagaggaaaucccugcgccccuuggcaccccugacuuuguugggaaaauccagggacugcucacccagacaacgagagccgauggcuccacccgggcucacaaggccacagugucuaccgggagcguccacuucauucccaagcugggauccgugcaauuuacaaccgacacgaacaaugauuuccagacaggccagaacaccaaauuuaccccgguuggggugauccaagacggagaucaucaccagaaugagccucagcaguggguccuucccaacuacagcggccgcacaggccauaaugugcaccuggcccccgcuguggccccuaccuucccgggggaacaacuccuguuuuucagaucuacaguucccggauguuccggcuauccuaacaugaaucuggacugccuccugccccaggagugggucagccacuuuuaccaggaagcggcuccugcccagucugauguggcccuucugcgguucgugaaccccgacacggggcgcguccucuuugaguguaagcugcauaaaagcggauauauuaccguggcucacacaggcccuuacgaucuuguucugcccccgaacggguauuucagauuugacuccugggugaaucaauucuacacccucgccccuaugggcaacggaacaggccggagacgcuga

SEQ ID NO: 30351 - RNA, 1614 nt, Artificial Sequence
  derived and/or modified sequence opt5 from VP1__Norovirus_and/or_Norovirus-like__X76716
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccugagccgcauguauaacggguacgcuggaggcuucgaaguccaggugauccuugccggcaaugcuuuuacagccgggaaaguuauuuucgcggccgugccucccaacuuuccuacggagggacugucccccucucaggucaccauguucccgcauaucaucguggacgugagacaacucgagccuguccugauuccccugccugauguucggaauaacuuuuaucacuacaaucaggcuaacgacagcacacucaagcugaucgccaugcuuuauacaccccugcgcgcuaacaaugccggcgaugacguguucaccguguccugcagaguccucacccggcccagcccugauuuugacuucauuuuucuggugccgcccacaguugaaucucgcaccaaaccuuucacggugcccguccuuaccguggaggaaauguccaacagcagauuuccuaucccccuggagaagcucuacacagggccgucuuccgccuucguugugcagccucagaauggacgguguaccacagauggcguccugcuggggaccacgcaacucagcgcugugaacauuugcaauuuccgcggagacgucacacauaucgcgggcucucacgauuauaccaugaaccuggccucccagaauuggagcaacuacgaccccacagaggaaauuccugcuccccuuggcaccccugacuuuguggggaaaauccagggacugcucacccagacaacgagagccgauggcuccacccgggcccauaaggcuacaguuucuaccgggagcgugcacuucacacccaagcugggauccguccaauuuaccacggacacaaauaacgauuuccaggccggccagaauaccaaauuuaccccgguggggguuauccaagacggagaucaccaucagaacgagccucagcaguggcuucugcccaauuacagcggccgcacaggccacaacgugcaucucgcgcccgcugucgccccuaccuucccgggggaacaacugcuguuuuucagaucuacaaugcccggauguuccggcuauccuaauaugaaccucgacugccugcuuccccaggagugggugcugcacuuuuaccaggaagccgcuccugcccagagcgauguggcucuccugcgguucguuaaccccgacacggggcgcguccuuuuugaguguaagcugcacaaaucuggauauauuaccguggcccauacaggcccuuacgaucucgugcugcccccgaauggguauuucagauuugacagcugggucaaccaauucuacacccuggcgccuaugggcaauggaacaggccggagacgcuga

SEQ ID NO: 30352 - RNA, 1614 nt, Artificial Sequence
  derived and/or modified sequence opt5 from VP1__Norovirus_and/or_Norovirus-like__KX514328
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaaccccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaauagcagauuucccauuaaccuugaacggcuguucaccggaccgucuuccgccaaugucgugcagccucagaacggccgcuguacaaucgauggggagcuccugggaaccacgcaacugagcucuguuaauaucugcacauucagaggcgacgugacccagauuggcuccacaaagcauuggaccaugaaccucgccagccccaauuggaacaauuacgauccuaccgaggaaacacccgcuccucuggggacgcccgacuuugucggaaaaauccacggcaugcuuacccagacaacccaggagaacggguccacacgggcgcaucgcgccaccguguaugucggaggcgcuaauuucacgccgaagcuggggaaggugcaauuugaaacagacaccguugaugaccucgagauuagacagaacaccaaauucacaccugugggagucauccagucuagcgaucaccaccgggacgaaccccaacaguggcgccugcccaauuacuccggcgccaacaccuuuaaugugcaucuugccccugcuguugccccgaacuuccccggcgagcagcugcucuuuuucagaagcacacugccuggguguggaggccaccccaacauggaucuggacugccuccugccucaggagugggugcaacauuuuuaccaggaagcggcucccgcccagucugaugucgcccuucugcgguucgugaauccugacacguccagagugcucuuugaguguaagcugcacaaaagcggguauguuaccgucgcucacacaggacaguacgaucuugugcugcccucuaacggcuauuuccgcuuugacagcugggugaaucaauucuacacccucgccccgauggggaacggcacaggacggagacgcuga

SEQ ID NO: 30353 - RNA, 1614 nt, Artificial Sequence
  derived and/or modified sequence opt5 from VP1__Norovirus_and/or_Norovirus-like__KX514201
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcaugucaucguggacgugagacaacucgagccuguccugauuccccugccugauguucggaauaacuuuuaucacuacaaucagagcaacgacuccaccaucaagcucauugccaugcuguauacaccccuucgcgcuaauaaccccggcgaugacguguucaccgugagcugcagaguccugacacggccuucuccggauuuugacuucaucuuucucgugcccccuaccguugaaucccgcacgaaacccuucagcgugccuauucugaccgucggggagaugacaaacucuagauuucccaucaaucuugaacggcuguucaccggaccguccagcgccaacgugguucagccucagaauggccgcuguacaauugauggggagcuccugggaaccacgcaacugucuuccgugaacaucugcacauucagaggcgacgucacccauaucggcagcacacaccauuggaccaugaaucucgccucccccaacuggaauaacuacgauccuaccgaggaaacacccgcuccucuggggacgcccgacuuugugggaaagauucacggcaugcuuacccagacaacccaggggucuggaagcacacgggcgcaccgcgccaccgucuaugugggcuccgcugaguucacgccgaaacuggggaagguucaguuuaagacagaaaccgaccaugaucucaccaucagacaaaauacaaaauucaccccugugggagucauucaggagagcgaccaccaucgggaugaaccccagcaauggcgccugcccaacuacucuggcgccaauacauuuaacgugcaccuugccccugcuguugccccgaauuuccccggcgagcagcugcucuuuuucagauccacgcugccuggguguggaggccaccccaacauggaccuggauugccuccugccucaggagugggugcagcauuuuuaccaagaagcggcucccgcccagagcgacgucgcccuucugcgguucgugaauccugauaccucuagagugcucuuugaguguaagcugcacaaaagcggguauguuacagucgcucauaccggacaguacgaccuugugcugcccuccaacggcuauuuccgcuuugauucuugggugaaccaguucuacacacucgccccgauggggaauggcaccggacggagacgcuga

SEQ ID NO: 30354 - RNA, 1614 nt, Artificial Sequence
  derived and/or modified sequence opt5 from VP1__Norovirus_and/or_Norovirus-like__AB985442
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacaucaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccagucccaugacagcacacucaagcugauugcuaugcuuuauacaccccugcgcgccaauaacgcuggcgaugacguuuucaccgugucuugcagagugcucacccggcccuccccugauuuugacuucaucuuucuggucccgcccacaguggaaagccgcaccaaaccuuucacgguucccauucuuaccguggaggaaaugucuaacuccagauuuccuaucccccuggagaagcucuacacagggccgagcucugccuucgucgugcagccucagaauggacgguguaccacagauggcguucugcuggggaccacgcaacucuccgccgugaacauuugcaauuuccgcggagacgucacacacaucgugggcagccaugauuauaccaugaaccuggcuucccagaauuggucuaacuacgaccccacagaggaaaucccugcgccccuuggcaccccugacuuugucgggaaaauucagggacugagaacccagacaacgcgggccgauggcagcacccgcgcucacaaggccacaguguccaccgggagcguucacuucacacccaagcucggaucugugcaauuuaccacggacacaaauaacgauuuccagaccggccagaauaccaaauuuacaccggucggggugauccaagacggagaucaucaccagaacgagccucagcaguggguucugcccaauuacuccggcagaaccggccauaacgugcaccuugcccccgcugucgccccuacauucccgggggaacaacugcucuuuuuccggagcacgaugcccggauguucuggcuauccuaauaugaaccuggacugccugcucccccaggagugggugcugcacuuuuaccaggaagcggcuccugcccagagcgauguggcccuucugcgcuucguuaaucccgacaccgggagaguccucuuugaguguaagcugcauaaauccggauauauuacaguggcucacaccggcccuuacgaucuugugauucccccgaacggguauuuccgguuugacucuugggucaaccaauucuacacacuggccccuaugggcaauggaaccggcagacgccgguga

SEQ ID NO: 30355 - RNA, 1614 nt, Artificial Sequence
  derived and/or modified sequence opt5 from VP1__Norovirus_and/or_Norovirus-like__LC016604
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggggucuguucaauucgacaccgauacaaacaaugaccucgagaccggacagaacacaagauuuacgcccgugggcgucauucaggauggcagcgcccaucggaaugaaccccaacagugggugcugccugacuacuccgggcgcaccguucacaacgugcaccuugcuccggccgucgcccccacauucccuggagagcagcugcucuuuuucagaagcaccaugcccggcuguucuggguacccuaauauggaucuggacugccugcucccccaggaaugggugcaacauuuuuaucaggaggcugccccugcgcaguccgauguggcucugcuucgguucguuaaccccgacacaggaagaguccuguuugaguguaagcuccacaaaaccggcuacgugacgguggcccauaccgggcagcacgaucuggucaucccgccuaauggcuauuuccgcuuugacagcugggugaaccaauucuacacacuugcccccaugggaaacggcgcugggcggagacgcuga

SEQ ID NO: 30356 - RNA, 1614 nt, Artificial Sequence
  derived and/or modified sequence opt5 from VP1__Norovirus_and/or_Norovirus-like__KF806532
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuuccgccuucgugguucagccccagaauggacgguguaccacagacggcgugcuccuggggaccacgcaacugagcccugucaacauuugcacauuucgcggagaucucacccauuucgcuggcacaucugaauacgcgaugaaucuggccucccagaacuggaccaauuaugaccccaccgaggaaaucccugcuccccuuggcgccccggauuuuguggggaagaucagaggaguccugacacagacgacccggcgcgacggcagcacaagagggcaccgggccacccucuccacaggaucugcucauuucaccccuaagcugggcagcauucgcuuuuccacggacacaaacaaugauuucgaggccgggcagaacaccaaauuuacccccgugggaguuuuccaagacggcgauaaucaccagaacgaaccccagcaaugggugcuuccuaauuacagcggcgcgacagcucacaacguccaucuggccccggccguggcucccgccuuuccuggggagcagcuccuguucuuuagaucuaccaugcccggauguuccggcuacccuaauaugaaccuggacugccuccugacacaggaguggguucagcacuucuaucaagaagcugcccccgcgcagagcgauguggcccuucugcgguuugucaauccugacacgucuagaguucucuucgaguguaagcugcauaaaagcggguacgugaccguggcucacacaggacagcacgaucuugucauucccccgaacggcuauuuccgcuuugacuccugggugaaccaguucuacacccuggccccuauggggaauggcacaggacggagacgcuga

SEQ ID NO: 30357 - RNA, 1614 nt, Artificial Sequence
  derived and/or modified sequence opt5 from VP1__Norovirus_and/or_Norovirus-like__FJ537138
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccugucccgcauguauaauggguacgcuggaggcuucgaaguccaggugauccuugccggcaacgcuuuuacagccgggaaaguuauuuucgcggccgugccucccaauuuuccuacggagggacugucucccagccaggucaccauguucccgcauaucaucguggacgugagacaacucgagccuguccugauuccccugccugauguucggaacaauuuuuaucacuacaaccaggcucaugacuccacacucaagcugaucgccaugcuuuauacaccccugcgcgcuaauaacgccggcgaugacguguucaccgugagcugcagaguccucacccggcccucuccugauuuugacuucauuuuucuggugccgcccacaguugaaucccgcaccaaaccuuucacggugcccauccuuaccgucgaggaaaugagcaacucuagauuuccuauuccccuggagaagcucuacacagggccguccagcgccuucgugguucagccucagaauggacgguguaccacagauggcgugcugcuggggaccacgcaacucucugcugucaacaucugcaauuuccgcggagacgugacaagagucggcauuucccacgauuauaccaugaaccuggugagccagaauuggaacaauuacgaccccacagaggaaaucccugcgccccuuggcaccccugacuuuguugggaaaauccagggacugcucacccagacaacgcgggccgauggcuccacccgcgcucauaaggccacagugucuaccgggagcguccacuucacacccaagcugggauccgugcaauuuaccacggacacaaacaaugauuuccagaccggccagaacaccaaauuuacaccgguuggggugauucaagacggagaucaccaucagaaugagccucagcaguggguccuucccaacuacagcggcaccucuggccacaaugugcaucuggcccccgcuguggccccuacauucccgggggaacaacuccuguuuuucagauccacgaugcccggauguagcggcuauccuaacaugaaucuggacugccuccugccccaggaguggguucuucacuuuuaccaggaagcggcuccugcccagucugaugucgcccugcuccgguucgugaaccccgacaccgggcgcgugcuguuugaguguaaacuucacaagagcggauauaucacagucgcucauaccggcccuuacgaucuggugauucccccgaacggguauuucagauuugacuccuggguuaaucaauucuacacacucgccccuaugggcaacggaaccggccggagacgcuga

SEQ ID NO: 30358 - RNA, 1614 nt, Artificial Sequence
  derived and/or modified sequence opt5 from VP1__Norovirus_and/or_Norovirus-like__AY030098
augaagauggccagcuccgacgcuaaccccucugauggcagcaccgccaaucuggugccugaggucaacaaugaaguuauggcgcucgagccgguggugggggcugccaucgccgcucccgucgccggacagcaaaacaucaucgacccuuggauuagaaauaacuucgugcaggcucccggcggggaauuuacaguuuccccucggaaugcccccggagagauccuguggucugcgccucuuggcccggaucugaaccccuaccucagccaccugucccgcauguauaauggguacgccggaggcuucgaagugcaggucauucuugcuggcaacgccuuuacggcugggaaagugaucuucgccgcgguuccucccaauuuuccuaccgagggacugucucccagccaggugacaauguucccgcauaucauugucgacgugagacaacucgagccugugcugaucccccugccugauguccggaacaauuuuuaucacuacaaccagucccaugacagcacccucaagcugauugccaugcuuuauacaccccugcgcgcuaauaacgccggcgaugacguuuucaccgugucuugcagagugcucacacggcccuccccugauuuugacuucaucuuucuggucccgcccaccguggaaagccgcacgaaaccuuucaccguucccauucuuacaguggaggaaaugucuaacuccagauuuccuaucccccuggagaagcucuacaccgggccgagcucugcuuucgucgugcagccucagaauggacgguguacaaccgauggcguucugcuggggacgacacaacucuccgccgugaacauuugcaauuuccgcggagacgucacccacaucgugggcagccaugauuauacaaugaaccuggucucccagaauuggucuaacuacgaccccaccgaggaaaucccugcuccccuuggcaccccugacuuuguggggaaaauucagggacugcucacacagacgaccagagccgauggcagcacacgggcgcacaaggccaccguuuccacagggagcgugcacuucacccccaagcugggaucuguccaauuuacgacagacaccaauaacgauuuccagaccggccagaauacaaaauuuaccccgguggggguuauccaagacggagaucaucaccagaacgagccucagcagugggugcuucccgacuacuccggccgcacaggccauaauguccaccuggcucccgccguggccccuacguucccgggggaacaacuccuguuuuucagaagcaccaugcccggauguucuggcuauccuaacaugaaucuggauugccuccugccccaggagugggugcuucacuuuuaccaggaagcugccccugcgcagagcgacguugcucugcuccgguucgucaaccccgauacagggcgcgugcuguuugaguguaaacuucauaaguccggauauauuaccguggcccacacaggcccuuacgaccuggucauucccccgaauggguauuucagauuugauucuugggugaaccaauucuacacccucgccccuaugggcaacggaacgggccggagacgcuga

SEQ ID NO: 30359 - RNA, 1614 nt, Artificial Sequence
  derived and/or modified sequence opt5 from VP1__Norovirus_and/or_Norovirus-like__AY532130
augaagauggccagcaacgacgcuaaucccuccgauggcucuaccgccaaccuggugccugaggucaauaacgaaguuauggcgcucgagccgguggugggggcugccaucgccgcucccgucgccggacagcaaaauaucaucgacccuuggauuagaaacaauuucgugcaggcucccggcggggaauuuacaguuagcccucggaacgcccccggagagauccugugguccgcgccucuuggcccggaucugaaucccuaccucucucaccuggcccgcauguauaacggguacgcuggaggcuucgaagugcaggucauucuugccggcaaugcuagcacggccgggaaaaucaucuuugcggccgugccucccaacuucccuaccgagggacugucccccucucagguuacaauguuuccgcauauuaucguggacgucagacaacucgagccugugcugauuccccugccugaugugcggaauaacuucuaucacuacaaucagagcaacgacuccaccaucaagcucauugcuaugcuguauacaccccuucgcgccaacaaugcuggcgaugacgucuuuaccguuagcugcagagugcugacacggcccucuccugauuucgacuuuaucuuccucgugccgcccaccgucgaaucccgcauuaaaccuuuuacggugcccauccugaccguugaggaaaugagcaacucuagauucccuaucccccuugagaagcuguacacagggccguccagcgccuuugugguccagccucagaauggacgguguaccacagauggcgugcuccuggggaccacgcaacugucugccguuaacauuugcacauuccgcggagacgugacccauaucgcuggcucccacgauuauacaaugaaucucgcgagccagaacuggaauaacuacgaccccaccgaggaaauuccugcuccccugggcaccccugacuucgucgggaaaauccagggaaugcuuacacagacgaccagagaggauggcuccacacgggcccauaaggccaccgugucuacagggagcgcccacuuuacccccaagcugggauccguccaauacacgacagacaccaauaacgauuuccagaccggccagaauacaaaauuuaccccgguggggguuauucaagacggaaacaaucaccagaacgaaccucagcagugggugcuccccagcuauucuggccgcacaggccauaauguccaccuggcucccgccguggcgccuacguucccgggggagcaacuucuguuuuucagauccaccaugcccggauguagcggcuacccuaacaugaaccucgauugccugcugccccaggaauggguucagcauuuuuaucaggaggcugccccugcccaaucugacguggcucuccugcgguucgucaaucccgauacagggcgcgugcuuuuugaguguaagcugcacaaaagcggauacgugaccguugcccacacaggcccucaugaccucgucauucccccgaacggguauuucagauuugauuccugggugaaucaguucuacacccuggcuccuaugcggaacggcgccggaagacgccgguga

SEQ ID NO: 30360 - RNA, 1614 nt, Artificial Sequence
  derived and/or modified sequence opt5 from VP1__Norovirus_and/or_Norovirus-like__KX514286
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccauuaaucuugaacggcuguucacaggaccguccagcgcuaacgucgugcagccucagaauggccgcuguaccaucgauggggagcuccugggaacgacacaacugucuuccguuaacaucugcaccuucagaggcgacgugacacauauuggcagcacccaccauuggaccaugaaucucgccucccccaacuggaauaacuacgauccuacagaggaaacgcccgccccucuggggacccccgacuuugucggaaagauccacggcaugcuuacacagaccacacaggagaaugggucuacccgggcucaccgcgcgacgguguaugucggaagcgccgacuucacaccgaaacugggcaaggugcaguuugaaaccgauaccgaggacgaucucgcuauuagacaaaacacaaaguucaccccuguuggggugauccaguccagcgaccaucaccgggaugaaccccagcaauggcgccugcccaauuacucuggagccaacacauuuaauguccaucuugccccugcuguggccccgaacuuccccggcgagcagcugcucuuuuucagauccacgcugccuggcugugggggacaccccaauauggaccuggauugccuccugccucaggaguggguucagcacuuuuaccaagaagcggcucccgcccagagcgacguggcccuucugcgguucgucaacccugauaccucuagagugcucuuugaguguaaacugcauaagagcggcuaugugacaguugcucacaccgggcaguacgaccuuguccugcccuccaacggauauuuccgcuuugauucuugggugaaucaguucuacacacucgccccgaugggcaacgggaccggccggagacgcuga

SEQ ID NO: 30361 - RNA, 1614 nt, Artificial Sequence
  derived and/or modified sequence opt5 from VP1__Norovirus_and/or_Norovirus-like__KX514202
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaacggcuguucaccggaccguccagcgccaacgucgugcagccucagaauggccgcuguacaaucgauggggagcuccugggaaccacgcaacugucuuccguuaacaucugcacauucagaggcgacgugacccauauuggcagcacacaccauuggaccaugaaucucgccucccccaacuggaauaacuacgauccuaccgaggaaacacccgcuccucuggggacgcccgacuuugucggaaagauccacggcaugcuuacccagacaacccaggggucuggaagcacacgggcgcaccgcgccaccguguaugucggcuccgcugaguucacgccgaaacuggggaaggugcaguuuaagacagaaaccgaccaugaucucaccauuagacaaaauacaaaauucaccccuguuggagugauccaggagagcgaccaccaucgggaugaaccccagcaauggcgccugcccaacuacucuggcgccaauacauuuaacguccaccuugccccugcuguggccccgaauuuccccggcgagcagcugcucuuuuucagauccacgcugccuggguguggaggccaccccaacauggaccuggauugccuccugccucaggaguggguucagcauuuuuaccaagaagcggcucccgcccagagcgacguggcccuucugcgguucgucaauccugauaccucuagagugcucuuugaguguaagcugcacaaaagcggguaugugacaguugcucauaccggacaguacgaccuuguccugcccuccaacggcuauuuccgcuuugauucuugggugaaccaguucuacacacucgccccgauggggaauggcaccggacggagacgcuga

SEQ ID NO: 30362 - RNA, 1614 nt, Artificial Sequence
  derived and/or modified sequence opt5 from VP1__Norovirus_and/or_Norovirus-like__DQ358208
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccugagccgcauguauaacggguacgcuggaggcuucgaaguccaggugauccuugccggcaaugcuuuuacagccgggaaaguuauuuucgcggccgugccucccaacuuuccuacggagggacugucccccucucaggucaccauguucccgcauaucaucguggacgugagacaacucgagccuguccugauuccccugccugauguucggaauaacuuuuaucacuacaaucaggcuaacgacagcacacucaagcugaucgccaugcuuuauacaccccugcgcgcuaacaaugccggcgaugacguguucaccguguccugcagaguccucacccggcccagcccugauuuugacuucauuuuucuggugccgcccacaguugaaucucgcaccaaaccuuucacggugcccguccuuaccguggaggaaauguccaacagcagauuuccuaucccccuggagaagcucuacacagggccgucuuccgccuucguugugcagccucagaauggacgguguaccacagauggcguccugcuggggaccacgcaacucagcgcugugaacauuugcaauuuccgcggagacgucacacauaucgcgggcucucacgauuauaccaugaaccuggccucccagaauuggagcaacuacgaccccacagaggaaauuccugcuccccuuggcaccccugacuuuguggggaaaauccagggacugcucacccagacaacgagagccgauggcuccacccgggcccauaaggcuacaguuucuaccgggagcgugcacuucacacccaagcugggauccguccaauuuaccacggacacaaauaacgauuuccaggccggccagaauaccaaauuuaccccgguggggguuauccaagacggagaucaccaucagaacgagccucagcaguggagccuucccaauuacucuggccgcacaggccacaacgugcaucuggcgcccgcugucgccccuaccuucccgggggaacaacuccuguuuuucagauccacaaugcccggauguagcggcuauccuaauaugaaccuggacugccuccugccccaggagugggugcuucacuuuuaccaggaagccgcuccugcccagucugauguggcucugcuccgguucguuaaccccgacacggggcgcguccuguuugaguguaagcuccacaaaagcggauauauuaccguggcccauacaggcccuuacgaucuggugcuucccccgaauggguauuucagauuugacuccugggucaaccaauucuacacccuggcgccuaugggcaauggaacaggccggagacgcuga

SEQ ID NO: 30363 - RNA, 1614 nt, Artificial Sequence
  derived and/or modified sequence opt5 from VP1__Norovirus_and/or_Norovirus-like__AF414425
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagccagcccucggaacgcgcccggagagauucugugguccgccccucuuggcccggaucugaaucccuaccucucucaccuggcucgcauguauaacggguacgccggaggcuucgaagugcaggucauccuugcuggcaaugccuuuacggcggggaaaauuaucuucgccgcugugccucccaacuuuccuaccgagggacugagccccucccagguuacaauguucccgcauaucauuguggacgucagacaacucgagccugugcugaucccccugccugaugugcggaauaacuuuuaucacuacaaucagucuaacgacagcaccauuaagcucaucgccaugcuguauacaccccuucgcgcuaacaaugccggcgaugacgucuucaccgccuccugcagaguucugacacggcccagcccugauuuugacuucauuuuucucgugccgcccaccguggaaucucgcacgaaaccuuucaccguccccauccugacaguggaggaaauguccaacagcagauuuccuauuccccuugagaagcuguacaccgggccgucuuccgcuuucguugugcagccucagagcggacgguguacaaccgauggcguccuccuggggacgacacaacugucugcggugaauaucugcaccuuccgcggagacguuacacauaucgccggcucccacgauuauaccaugaaccucgcuagccagaauuggaacaauuacgaccccaccgaggaaauuccugcuccccugggcacaccugacuuuguggggaaaauccagggaaugcuuacgcagaccacaagagaggauggcuccacccgggcccauaaggccacagucucuaccgggagcgugcacuucacgcccaagcugggauccguccaauacacaaccgacaccaacaaugauuuucagacaggccagaacaccaaauucacaccgguggggguuauucaagacggaaauaaccaccagaaugaaccucagcagugggugcuccccaacuauagcggccgcacgggccauaauguccaccuggcccccgcgguggcuccuaccuuuccgggggagcaacuucuguucuuuaagucuacaaugcccggauguuccggcuacccuaacaugaaccucgauugccugcugccccaggaauggguucagcauuucuaucaggaggccgccccugcucaaagcgacguggcccuccugagauuugucaaucccgauaccgggcgggugcuuuucgaguguaaacugcacaagucuggauacgugacaguugcucacaccggcccucaugaccucgucauucccccgaacggguauuuucgcuucgauagcugggugaaucaguuuuacacgcuggccccuaugggcaacggagcgggcagacggagauga

SEQ ID NO: 30364 - RNA, 1614 nt, Artificial Sequence
  derived and/or modified sequence opt5 from VP1__Norovirus_and/or_Norovirus-like__KX514348
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaaccccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaauagcagauuucccgucaaccuugaacggcuguucaccggaccgucuuccgccaaugugguucagccucagaacggccgcuguacaauugauggggagcuccugggaaccacgcaacugagcucugugaauaucugcacauucagaggcgacgucacccagaucggcuccacaaagcauuggaccaugaaccucgccagccccaauuggaacaauuacgauccuaccgaggaaacacccgcuccucuggggacgcccgacuuugugggaaaaauucacggcaugcuuacccagacaacccaggagaacggguccacacgggcgcaucgcgccaccgucuaugugggaggcgcuaauuucacgccgaagcuggggaagguucaauuugaaacagacaccguggaugaccucgagaucagacagaacaccaaauucacaccugucggagugauucagucuagcgaucaccaccgggacgaaccccaacaguggguucugcccuccuacagcggccgcgauaccccuaaugugcaucuugccccggccgucgcucccaacuuuccuggcgagcagcuccuguucuuuagaucuacacugcccggguguggaggccaccauaauauggaccuggauugccuccugccucaggagugggugcaacacuucuaccaggaagccgcgcccgcucaguccgacguggcccuucugcgguuuguuaacccugauacgagcagaguccucuucgaguguaagcugcacaaaucuggguaugugaccguggcccauacaggacaguacgaccuuguccugcccagcaacggcuauuuucgcuucgauuccugggugaaucaauuuuacacccucgcuccgauggggaacggcacaggacggagacgcuga

SEQ ID NO: 30365 - RNA, 1614 nt, Artificial Sequence
  derived and/or modified sequence opt5 from VP1__Norovirus_and/or_Norovirus-like__KX514287
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaacggcuguucaccggaccguccagcgccaacgucgugcagccucagaauggccgcuguacaaucgauggggagcuccugggaaccacgcaacugucuuccguuaacaucugcacauucagaggcgacgugacccagauuggcagcacacaucacuggaccaugaaucucgccucccccaacuggaauaacuacgauccuaccgaggaaacacccgcuccucuggggacgcccgacuuugucggaaagauccauggcaugcuuacccagacaacccaggagaaugggucuacacgggcgcaccgcgccaccguguaugucggaagcgcugacuucacgccgaaacugggcaaggugcaauuugaaacagauaccggggacgaucucgccauuagacagaacaccaaguucacaccuguuggagugauccaguccagcgaccaccaucgggaugagccccaacaguggcgccugcccaauuacucuggcgccaacaccuuuaauguccaccuugcuccugccguggcgccgaacuuccccggcgaacagcugcucuuuuucagauccacacugccuggguguggaggccaucccaauauggaccuggauugccuccugccucaggaguggguucaacacuuuuaccaggaggcugcccccgcccagagcgacguggcccuucugcgguucgucaacccugauacgucuagagugcucuuugaauguaaacugcacaagagcggguaugugaccguugcucauacaggacaguacgaccuuguccugcccuccaacggcuauuuccgcuuugauucuugggugaaucaauucuacacccucgcuccgauggggaacggcacaggacggagacgcuga

SEQ ID NO: 30366 - RNA, 1614 nt, Artificial Sequence
  derived and/or modified sequence opt5 from VP1__Norovirus_and/or_Norovirus-like__KX514183
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccgucaaucuugaacggcuguucaccggaccguccagcgccaacgugguucagccucagaauggccgcuguacaauugauggggagcuccugggaaccacgcaacugucuuccgugaacaucugcacauucagaggcgacgucacccauaucggcacaacccagcacuggaccaugaaucucgccagccccaacuggaauaacuacgauccuacagaggaaacgcccgcuccucuggggacccccgacuuugugggaaagauucauggcaugcuuacacagaccacacagggguccggaucuacccgggcgcaccgcgccacggucuaugugggcagcgcugaguucacaccgaaacuggggaagguuagauuugaaaccgacaccgaggaugaccucgugauccggcaaaauacaaaguucaccccugucggagugauucaguccagcgaacaccaucgcgaugagccccagcaauggagacugcccaacuacucuggcgccaauacauuuaacguucaccuugccccugcuguggccccgaauuuccccggcgagcagcugcucuuuuuccgguccacgcugccuggguguggaggccaucccaacauggaccuggauugccuccugccucaggaauggguccagcacuuuuaccaagaggcggcucccgcccagagcgacguggcccuucugagauucgugaauccugauaccucucgcguucucuuugaauguaaacugcacaagagcggguaugucacaguggcucauaccggacaguacgaccuugugcugcccuccaacggcuauuuccgguuugauucuugggucaaccaguucuacacacucgccccgauggggaauggcaccggaagacgccgguga

SEQ ID NO: 30367 - RNA, 1614 nt, Artificial Sequence
  derived and/or modified sequence opt5 from VP1__Norovirus_and/or_Norovirus-like__KX514174
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaaccccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaauagcagauuucccgucaaccuugaacggcuguucaccggaccgucuuccgccaaugugguucagccucagaacggccgcuguacaauugauggggagcuccugggaaccacgcaacugagcucugugaauaucugcacauucagaggcgacgucacccauaucggcacaacccagcacuggaccaugaaccucgccucccccaauuggaacaauuacgauccuacagaggaaacgcccgcuccucuggggacccccgacuuugugggaaagauucauggcaugcuuacacagaccacacaggggagcggauccacccgggcgcaccgcgccacggucuaugugggcucugcugaguucacaccgaaacuggggaagguuagauuugaaaccgacaccgaggaugaccucgugauccggcaaaacacaaaguucaccccugucggagugauucagagcuccgaacaccaucgcgaugagccccagcaauggagacugcccaauuacagcggcgccaacacauuuaauguucaccuugccccugcuguggccccgaacuuccccggcgagcagcugcucuuuuuccggucuacgcugccuggguguggaggccaucccaauauggaccuggauugccuccugccucaggaauggguccagcacuuuuaccaagaggcggcucccgcccaguccgacguggcccuucugagauucgugaacccugauaccagccgcguucucuuugaauguaaacugcacaagucuggguaugucacaguggcucauaccggacagcacgaccuugugauucccccgaacggcuacuuccgguuugauagcugggucaaucaguucuauacacuggccccuauggggaacggcaccggaagaaaacgcuga

SEQ ID NO: 30368 - RNA, 1614 nt, Artificial Sequence
  derived and/or modified sequence opt5 from VP1__Norovirus_and/or_Norovirus-like__KF429791
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccggccaggugacaauguucccgcauaucauugucgacgugagacaacucgagccugugcugaucccccugccugauguccggaacaauuuuuaucacuacaaccagucuaaugaccccaccauuaagcucguugcuaugcuguauacaccccuucgcgccaacaacgcuggggaugacguguucaccgugagcugcagaguccugacacggccuuccccggauuuugacuucaucuuucucgugcccccuaccauugaaagcaaaacgaagucuuucuccguucccauccugaccauugaggaaaugacaaauagccgcuuuccuaucccccuugagaaacuguucaccggaccgucuuccacacucgugguccagccucagaacggcagauguaccacggauggggugcugcugggaacaacccaacucagccccguuaauaucugcacauuccggggcgacgugacccagauuaccaacacacauucuuacgagaugaaucuggccgcccagaacuggaacuccuaugauccuacggaagagauccccgcuccucuuggcacccccgacuuugucgggaagauucagggagugcugacacaaaccacaaaggaaaauggcagcacccgcgcgcacaaagccacggucuacacaggguccaccggauucaccccgaagcucggcagagugcaguuuguuacagacaccgaucgggaccuggagacaaaucaggauacgaaauucaccccugugggggucauccaagacggagaugcucaucagaacgaaccccagcagugggugcuucccucuuaccugggcacaaauaaccacaauguucaccucgccccugccguggcuccgaccuuucccggcgagcaacugcuguucuuucgcagcacaaugccuggguguuccggauaucccaacaugaaucucgacugccugcuuccucaggaguggguccaguacuucuaucaggaagccgcgcccgcucaaagcgauguggcccugcucagauuugugaacccugacaccggccggguucuguucgaguguaaacuucauaagucuggguacgucacgguggcccacaccggacgccaugaucuggugauucccccgaacggcuauuuuagauucgacuccugggucagcccuuuuuacacacucgcucccauggggaauggcaccggacggagacgcuga

SEQ ID NO: 30369 - RNA, 1614 nt, Artificial Sequence
  derived and/or modified sequence opt5 from VP1__Norovirus_and/or_Norovirus-like__AF427115
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccauccccauucugacaggggaggaaauguccaacagcagauuuccuaucccccuugagaagcuguacaccggaccgucuuccgccuucguugugcagccucagaauggccgguguacaaccgaugggguccuccugggaacgacacaacugagcgccgugaacaucugcaccuucaaaggcaauguuauucauaucgcuggcucucacgacuauacaaugaaccucgcgucccagaauuggaacaauuacgaucccaccgaggaaaccccugcuccccuggggacaccugacuuugugggaaagauucagggccuucugacgcagaccacacgcgaggacgggagcaccagagcccauaaggccacagucuccgccggaucugugcacuucacccccaaacucggcagcguccaauacacgacagauaccaacaaugacuuucagaccgggcagaacacaaaguucaccccggugggaguuauccaagauggcaauaaccaccagaaugaaccucagcagugggugcugcccaacuauuccggccgggcugggcauaacguccaccuugcccccgcgguggcuccuacauuuccgggagagcaacuccuguucuuucgcagcacgaugcccggcuguucuggguacccuaauaugaaccuggacugccugcucccccaggaauggguucagcauuucuaucaggaggccgccccugcucaauccgauguggcccugcuuagauuugucaaucccgacaccggacgggugcuguucgaguguaaacuccacaagagcggcuacgugacaguugcucacaccgggccucaugaucuggucauucccccgaacggcuauuuucgcuucgacucuugggugaaucaguuuuacacacuugccccuaugggaaacggcgcggggagacggagauga

SEQ ID NO: 30370 - RNA, 1614 nt, Artificial Sequence
  derived and/or modified sequence opt5 from VP1__Norovirus_and/or_Norovirus-like__KX514314
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaucccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaacagcagauuucccauuaaucuugaacggcuguucaccggaccgucuuccgcuaacgucgugcagccucagaauggccgcuguacaaucgauggggagcuccugggaaccacgcaacugagcucuguuaacaucugcacauucagaggcgacgugacccagauuggcuccacaaagcauuggaccaugaaucucgccagccccaacuggaauaacuacgauccuaccgaggaaacacccgccccucuggggacgcccgacuuugucggaaaaauccacggcaugcuuacccagacaacccaggagaauggguccacacgggcucaucgcgcgaccguguaugucggaggcgccaacuucacgccgaagcuggggaaggugcaauuugaaacagacaccggagaugaccucgcuauuagacagaauaccaaauucacaccuguuggcgugauccagucuagcgaucaccaccgggacgagccccaacaguggcgccugcccaacuacuccggcgccaauaccuuuaacguccaucuugccccugcuguggccccgaacuuccccggggaacagcugcucuuuuucagaagcacacugccuggauguggcgggcaccccaauauggaucuggacugccuccugccucaggaguggguucaacauuuuuaccaggaggcggcucccgcccagucugauguggcccuucugcgguucgucaacccugacacguccagagugcucuuugaauguaagcugcacaaaagcggauaugugaccguugcucacacaggccaguacgaucuuguccugcccucuaauggguauuuccgcuuugacagcugggugaaccaauucuacacccucgccccgaugggcaauggaacaggccggagacgcuga

SEQ ID NO: 30371 - RNA, 1614 nt, Artificial Sequence
  derived and/or modified sequence opt5 from VP1__Norovirus_and/or_Norovirus-like__KX514208
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaacggcuguucaccggaccguccagcgccaacgucgugcagccucagaauggccgcuguacaaucgauggggagcuccugggaaccacgcaacugucuuccguuaacaucugcacauucagaggcgacgugacccauauuggcagcacacaccauuggaccaugaaucucgccucccccaacuggaauaacuacgauccuaccgaggaaacacccgcuccucuggggacgcccgacuuugucggaaagauccacggcaugcuuacccagacaacccaggggucuggaagcacacgggcgcaccgcgccaccguguaugucggcuccgcugaguucacgccgaaacuggggaaggugcaguuuaagacagaaaccgaccaugaucucagcauuagacaaaauaccaaauucacaccuguuggagugauccaggagucugaccaccaucgggaugaaccccagcaauggcgccugcccaacuacuccggcgccaauaccuuuaacguccaccuugccccugcuguggccccgaauuuccccggcgagcagcugcucuuuuucagaagcacacugccuggguguggaggccaccccaacaugaaucuggacugccuccugccucaggaguggguucagcauuuuuaccaagaagcggcucccgcccagucugauguggcccuucugcgguucgucaacccugacacgagcagagugcucuuugaguguaagcugcacaaauccggguaugugaccguugcucauacaggacaguacgaucuuguccugcccucuaacggcuauuuccgcuuugacagcugggugaaucaguucuacacccucgccccgauggggaacggcacaggacggagacgcuga

SEQ ID NO: 30372 - RNA, 1614 nt, Artificial Sequence
  derived and/or modified sequence opt5 from VP1__Norovirus_and/or_Norovirus-like__KX514206
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaacggcuguucaccggaccguccagcgccaacgucgugcagccucagaauggccgcuguacaaucgauggggagcuccugggaaccacgcaacugucuuccguuaacaucugcacauucagaggcgacgugacccauauuggcagcacacaccauuggaccaugaaucucgccucccccaacuggaauaacuacgauccuaccgaggaaacacccgcuccucuggggacgcccgacuuugucggaaagauccacggcaugcuuacccagacaacccaggggucuggaagcacacgggcgcaccgcgccaccguguaugucggcuccgcugaguucacgccgaaacuggggaaggugcaguuuaagacagaaaccgaccaugaucucagcauuagacaaaauaccaaauucacaccuguuggagugauccaggagucugaccaccaucgggaugaaccccagcaauggcgccugcccaacuacuccggcgccaauaccuuuaacguccaccuugccccugcuguggccccgaauuuccccggcgagcagcugcucuuuuucagaagcacacugccuggguguggaggccaccccaacauggaccuggauugccuccugccucaggaguggguucagcauuuuuaccaagaagcggcucccgcccagucugacguggcccuucugcgguucgucaauccugauacgagcagagugcucuuugaguguaagcugcacaaauccggguaugugaccguugcucauacaggacaguacgaccuuguccugcccucuaacggcuauuuccgcuuugauagcugggugaaccaguucuacacccucgccccgauggggaauggcacaggacggagacgcuga

SEQ ID NO: 30373 - RNA, 1614 nt, Artificial Sequence
  derived and/or modified sequence opt5 from VP1__Norovirus_and/or_Norovirus-like__KX514198
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaacggcuguucaccggaccguccagcgccaacgucgugcagccucagaauggccgcuguacaaucgauggggagcuccugggaaccacgcaacugucuuccguuaacaucugcacauucagaggcgacgugacccauauuggcagcacacaccauuggaccaugaaucucgccucccccaacuggaauaacuacgauccuaccgaggaaacacccgcuccucuggggacgcccgacuuugucggaaagauccacggcaugcuuacccagacaacccaggggucuggaagcacacgggcgcaccgcgccaccguguaugucggcuccgcugaguucacgccgaaacuggggaaggugcaguuuaagacagaaaccgaccaugaucucaccacaagacaaaauaccaaauucacaccuguuggagugauucaggagagcgaccaccaucgggaugaaccccagcaauggcgccugcccaacuacucuggcgccaauacguuuaacguccaccuugccccugcuguggccccgaauuuccccggcgagcagcugcucuuuuucagauccacccugccuggguguggaggccaccccaacauggaccuggauugccuccugccucaggaguggguucagcauuuuuaccaagaagcggcucccgcccagagcgacguggcccuucugcgguucgucaauccugauacaucuagagugcucuuugaguguaagcugcacaaaagcggguaugugaccguugcucauacaggacaguacgaccuuguccugcccuccaacggcuauuuccgcuuugauucuugggugaaccaguucuacacccucgccccgauggggaauggcacgggacggagacgcuga

SEQ ID NO: 30374 - RNA, 1614 nt, Artificial Sequence
  derived and/or modified sequence opt5 from VP1__Norovirus_and/or_Norovirus-like__KX514191
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccgucaaucuugaacggcuguucaccggaccguccagcgccaacgugguucagccucagaauggccgcuguacaauugauggggagcuccugggaaccacgcaacugucuuccgugaacaucugcacauucagaggcgacgucacccauaucggcacaacccggcacuggaccaugaaucucgccagccccaacuggaauaacuacgauccuacagaggaaacgcccgcuccucuggggacccccgacuuugugggaaagauucauggcaugcuuacacagaccacacagggguccggaucuacccgcgcgcacagagccacggucuaugugggcagcgcugaguucacaccgaaacuggggaagguucgguuugaaaccgacaccgaggaugaccucgugauccgccagaauacaaaguucaccccugucggagugauucaauccagcgaacaccauagagaugagccccagcaguggcggcugcccaacuacucuggcgccaauacauuuaacguucaccuugccccugcuguggccccgaauuuccccggcgagcaacugcucuuuuucagauccacgcugccuggguguggaggccaucccaacauggaccuggauugccuccugccucaggaauggguccagcacuuuuaccaggaggcggcucccgcccaaagcgacguggcccuucugcgcuucgugaauccugauaccucucggguucucuuugaauguaaacugcacaagagcggguaugucacaguggcucauaccggacaguacgaccuugugcugcccuccaacggcuauuucagauuugauucuugggucaaccaguucuacacacucgccccgauggggaauggcaccggacgccggagauga

SEQ ID NO: 30375 - RNA, 1614 nt, Artificial Sequence
  derived and/or modified sequence opt5 from VP1__Norovirus_and/or_Norovirus-like__KX514187
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccgucaaucuugaacggcuguucaccggaccguccagcgccaacgugguucagccucagaauggccgcuguacaauugauggggagcuccugggaaccacgcaacugucuuccgugaacaucugcacauucagaggcgacgucacccauaucggcacaacccggcacuggaccaugaaucucgugagccccaacuggaauaacuacgauccuacagaggaaacgcccgccccucuggggacccccgacuuugucggaaagauucauggcaugcuuacacagaccacacagggguccggaucuacccgcgcucacagagcgacgguguauguuggcagcgccgaguucacaccgaaacuggggaaggugcgguuugaaaccgacaccgaggaugaccucgucauccgccagaauacaaaguucaccccugugggaguuauucaauccagcgaacaccauagagaugagccccagcaguggcggcugcccaacuacucuggcgcuaauacauuuaacgugcaccuugccccugccgucgcuccgaauuuccccggcgagcaacugcucuuuuucagauccacgcugccuggguguggaggccaucccaacauggaccuggauugccuccugccucaggaaugggugcagcacuuuuaccaggaggccgcgcccgcucaaagcgacguggcccuucugcgcuucguuaauccugauaccucucggguccucuuugaauguaaacugcacaagagcggguaugugacaguggcccauaccggacaguacgaccuuguccugcccuccaacggcuauuucagauuugauucuugggugaaccaguucuacacacucgcuccgauggggaauggcaccggacgccggagauga

SEQ ID NO: 30376 - RNA, 1614 nt, Artificial Sequence
  derived and/or modified sequence opt5 from VP1__Norovirus_and/or_Norovirus-like__KX514180
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucauucaggcccccggcggggaauuuaccguuuccccucggaaugcgcccggagagauccuguggucugccccucuuggcccggaucugaaccccuaccucagccaccuggcucgcauguauaauggguacgccggaggcuucgaagugcaggucauucuugcuggcaacgccuuuacagcggggaaaaucaucuucgccgcugugccucccacguuuccuaccgagggacugucccccucucagguuacaauguucccgcauauuaucguggacgucagacaacucgagccugugcugauuccccugccugaugugcggaauaacuuuuaucacuacaaucagagcaacgacuccaccaucaagcucauugccaugcuguauacaccccuucgcgcuaauaaccccggcgaugacgucuucaccguuagcugcagagugcugacacggccuucuccggauuuugacuucaucuuucucgugcccccuaccgucgaaucccgcacgaaacccuucagcgugccuauucugaccguuggggagaugacaaacucuagauuucccaucaaucuugaacggcuguucaccggaccguccagcgccaacgugguccagccucagaauggccgcuguacaaucgauggggagcuccugggaaccacgcaacugucuuccgugaacauuugcacauucagaggcgacguuacccagaucggcagcacacagcauuggaccaugaaucucgccucccccaacuggaauaacuacgauccuaccgaggaaacacccgcuccucuggggacgcccgacuuugugggaaagauucacggcaugcuuacccagacaacccaagagaaugggucuacacgggcgcaucgcgccaccgucuaugugggaagcgcuaacuucacgccgaaacugggcaagguccaguuugaaacagacaccggggaugaccucgccaucagacagaauaccaaguucacaccugugggaguuauucaauccagcgaucaccaccgggacgagccccagcaguggcgccugcccaacuacucuggcgccaauaccuuuaacgugcaucuugcuccugccgucgcgccgaauuuccccggcgaacagcugcucuuuuucagauccacacugccuggguguggaggccaccccaacauggaucuggacugccuccugccucaagagugggugcagcauuuuuaccaggaggcugcccccgcccagagcgauguugcccuucugcgguucgugaacccugacacgucuagaguccucuuugaauguaaacugcacaagagcggguaugugaccguggcucacacaggacaauacgaucuuguucugcccuccaauggcuauuuccgcuuugacucuugggucaaccaguucuacacccucgcuccgauggggaauggcacaggacggagacgcuga

SEQ ID NO: 30377 - RNA, 1614 nt, Artificial Sequence
  derived and/or modified sequence opt5 from VP1__Norovirus_and/or_Norovirus-like__GU598213
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacagcuggaucagaaacaauuucguucaggcuccuggcggggaauuuacagugucuccccggaacgccccuggagagauucugugguccgcgccccuuggcccugaucugaauccguaccucagccaccuggcccgcauguauaacggguacgcuggaggcuucgaaguccaggugauccuugccggcaaugcuuuuacggccgggaaaauuaucuucgcggccguucccccuaacuuucccaccgagggacuguccccuucucaggugacaauguucccccauaucauugucgacgugagacaacucgagccggugcugaucccucugcccgauguccggaauaacuuuuaucacuacaaucagagcaacgacuccaccauuaagcucaucgcuaugcuguauacaccucuucgcgccaacaaugcuggcgaugacguuuucaccgugagcugcagagugcugacacggcccucucccgauuuugacuucauuuuucucgucccuccgaccguggaaucccgcacgaaacccuucaccguuccuauccugacaguggaggaaaugagcaacucuagauuucccauuccucuugagaagcuguacaccgggcccuccagcgccuucgucgugcagccgcagaauggacgguguacaaccgauggcguucuccuggggacgacacaacugucugccgugaacaucugcaccuuccgcggagacgucacacauaucgcuggcucccacgauuauaccaugaaucucgcgagccagaacugguccaauuacgacccuaccgaggaaauucccgccccucugggcacacccgacuuuguggggaaaauccagggaaugcuuacgcagaccacaagagaggauggcucuacccgggcucauaaggccacagucagcaccggguccgugcacuucacgccuaagcugggaagcguucaauacacaaccgacaccaacaaugauuuucagacaggccagaacaccaaauucacacccgugggggucauucaagacggaaauaaccaccagaaugaaccgcagcagugggugcucccuaacuauucuggccgcacgggccauaauguucaccuggcccccgcuguggcccccaccuuuccuggggagcaacuucuguucuuuagauccacaaugccgggauguagcggcuaccccaacaugaaccucgauugccugcugccucaggaauggguccagcauuucugucaggaggcggcucccgcccaaucugacguggcccuccugcgguuugugaauccugauaccgggcgcguucuuuucgagugcaagcugcacaaaagcggauaugucacaguggcucacaccggcccccaugaccucgugaucccucccaacggguacuuuagauucgauuccugggucaaucaguuuuauacgcuggccccgaugggcaacggagcuggccggagacgcuga

SEQ ID NO: 30378 - RNA, 1614 nt, Artificial Sequence
  derived and/or modified sequence opt5 from VP1__Norovirus_and/or_Norovirus-like__KX514365
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccauuaaucuugaacggcuguucacaggaccguccagcgcuaacgucgugcagccucagaauggccgcuguaccaucgauggggagcuccugggaacgacacaacugucuuccguuaacaucugcaccuucagaggcgacgugacacagauucggagcacccagcauuggaccaugaaucucgccucccccaacuggaauaacuacgauccuacagaggaaacgcccgccccucugggcacccccgacuuugucgggaagauccacggaaugcuuacacagaccacacaagagaauggcucuacccgcgcucauagagcgacgguguaugucgggagcgccaacuucacaccgaaacugggaaaggugcaguuugaaaccgacaccggcgaugaccucgcuauucggcagaauacaaaguucaccccuguuggggugauccaauccagcgaucaccaccgcgacgagccccagcaguggagacugcccaacuacucuggagccaauacauuuaacguccaucuugccccugcuguggccccgaauuuccccggcgaacagcugcucuuuuuccgguccacgcugccuggcugugggggacaccccaacauggaucuggacugccuccugccucaagaguggguucagcauuuuuaccaggaggcggcucccgcccagagcgauguggcccuucugagauucgucaacccugacaccucucgcgugcucuuugaauguaaacugcacaagagcggcuaugugacaguugcucacaccgggcaauacgaucuuguccugcccuccaauggauauuuccgguuugacucuugggugaaccaguucuacacacucgccccgaugggcaaugggaccggcagacgccgguga

SEQ ID NO: 30379 - RNA, 1614 nt, Artificial Sequence
  derived and/or modified sequence opt5 from VP1__Norovirus_and/or_Norovirus-like__KX514304
augaagauggugagcaacgacgccaaucccuccgauggcucugcugccaaccuggucccugagguuaauaacgaagugauggcgcucgagccgguggucggggcugccaucgccgcucccguggccggacagcaaaauguuauugacccuuggaucagaaacaauuucgugcaggcucccggcggggaauuuaccgucagcccucggaacgcccccggagagauucugugguccgcgccucuuggcccggaucugaaucccuaccucucucaccuggcccgcauguauaacggguacgcuggaggcuucgaagugcagguuauccuugccggcaaugcuuuuacagccgggaaaauuaucuucgcggccgugccucccacguuuccuaccgagggacugagccccucccaggucacaauguucccgcauaucauuguggacgugagacaacucgagccuguccugaucccccugccugauguucggaacaauuuuuaucacuacaaccagucuaaugacagcaccauuaagcucaucgcuaugcuguauacaccccuucgcgccaacaaccccggcgaugacguguucaccguguccugcagaguccugacacggccuagcccggauuuugacuucauuuuucucgugcccccuaccguugaaucucgcacgaaacccuucuccgugccuauccugaccgucggggagaugacaaauagcagauuucccauuaaccuugaacggcuguucaccggaccgucuuccgcuaaugugguucagccucagaacggccgcuguacaaucgauggggagcuccugggaaccacgcaacugagcucugugaauaucugcacauucagaggcgacgucacccagauuggcuccacaaagcauuggaccaugaaccucgccagccccaauuggaacaauuacgauccuaccgaggaaacacccgccccucuggggacgcccgacuuugugggaaaaauccacggcaugcuuacccagacaacccaggagaacggguccacacgggcucaucgcgcgaccgucuaugugggaggcgccaauuucacgccgaagcuggggaagguucaauuugaaacagacaccggagaugaccucgcuauuagacagaacaccaaauucacaccugugggcgucauccagucuagcgaucaccaccgggacgagccccaacaguggcgccugcccaauuacuccggcgccaacaccuuuaaugugcaucuugccccugcuguugccccgaacuuccccggggaacagcugcucuuuuucagaagcacacugccuggauguggcgggcaccccaacauggaucuggacugccuccugccucaggagugggugcaacauuuuuaccaggaggcggcucccgcccagucugaugucgcccuucugcgguucgugaauccugacacguccagagugcucuuugaauguaagcugcacaaaagcggauauguuaccgucgcucacacaggccaguacgaucuugugcugcccucuaacggguauuuccgcuuugacagcugggugaaucaauucuacacccucgccccgaugggcaacggaacaggccggagacgcuga

SEQ ID NO: 30380 - RNA, 1614 nt, Artificial Sequence
  derived and/or modified sequence opt5 from VP1__Norovirus_and/or_Norovirus-like__KX514302
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaacggcuguucaccggaccguccagcgccaacgucgugcagccucagaauggccgcuguacaaucgauggggagcuccugggaaccacgcaacugucuuccguuaacaucugcacauucagaggcgacgugacccagauuggcagcacacagcauuggaccaugaaucucgccucccccaacuggaauaacuacgauccuaccgaggaaacacccgcuccucuggggacgcccgacuuugucggaaagauccacggcaugcuuacccagacaacccaagagaaugggucuacacgggcgcaucgcgccaccguguaugucggaggcgcuaacuucacgccgaaacuggggagagugcaguuugaaacagacaccaccgaugaccucgaugcccaccagaauacaaaguucaccccuguuggagugauucaaagcuccgaccaccaucgggaugagccccagcaguggcgccugcccaacuacagcggcgccaauacauuuaacguccaccuugcuccugccguggcgccgaauuuccccggcgaacagcugcucuuuuucagaucuacgcugccuggguguggaggccaucccaacauggaccuggauugccuccugccucaagaguggguucagcacuuuuaccaggaggcugcccccgcccaguccgacguggcccuucugcgguucgucaacccugauaccagcagagugcucuuugaauguaagcugcacaaaucuggguaugugacaguugcucauaccggacaauacgaccuuguccugcccagcaauggcuauuuccgcuuugauuccugggugaaccaguucuacacacucgcuccgauggggaauggcaccggacggagacgcuga

SEQ ID NO: 30381 - RNA, 1614 nt, Artificial Sequence
  derived and/or modified sequence opt5 from VP1__Norovirus_and/or_Norovirus-like__KX514207
augaagauggccagcuccgacgcuaaccccucugauggcagcgccgcgaaucuggugccugaggucaacaaugaaguuauggcucucgagccgguggugggggccgccaucaccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccauuaaucuugaacggcuguucacaggaccguccagcgcuaacgucgugcagccucagaauggccgcuguaccaucgauggggagcuccugggaacgacacaacugucuuccguuaacaucugcaccuucagaggcgacgugacacauauuggcagcacccaccauuggaccaugaaucucgucucccccaacuggaauaacuacgauccuacagaggaaacgcccgccccucuggggacccccgacuuugugggaaagauccacggcaugcuuacacagaccacacaggggucuggaagcacccgggcccaccgcgcuacggucuaugugggcuccgcggaguucacaccgaaacuggggaagguucaguuuaagaccgaaaccgaccaugaucucagcauuagacaaaauacaaaauucaccccugugggagucauccaggagucugaccaccaucgggaugaaccccagcaauggcgccugcccaacuacuccggcgccaaugcuuuuaacgugcaccuugccccugccguugcuccgaauuuccccggcgagcagcugcucuuuuucagaagcacacugccuggguguggaggccaccccaacauggaccuggauugccuccugccucaggagugggugcagcauuuuuaccaagaagccgcgcccgcucagucugacgucgcccuucugcgguucgugaauccugauacgagcagagugcucuuugaguguaagcugcacaaauccggguauguuaccgucgcccauacaggacaguacgaccuugugcugcccucuaacggcuauuuccgcuuugauagcugggugaaccaguucuacacccucgcuccgauggggaauggcacaggacggagacgcuga

SEQ ID NO: 30382 - RNA, 1614 nt, Artificial Sequence
  derived and/or modified sequence opt5 from VP1__Norovirus_and/or_Norovirus-like__KX514192
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccgucaaucuugaacggcuguucaccggaccguccagcgccaacgugguucagccucagaauggccgcuguacaauugauggggagcuccugggaaccacgcaacugucuuccgugaacaucugcacauucagaggcgacgucacccauaucggcgccacacggcacuggaccaugaaucucgcuagccccaacuggaauaacuacgauccuaccgaggaaacacccgcgccucuggggacgcccgacuuugugggaaagauucauggcaugcuuacccagacaacccagggguccggaucuacacgcgcccacagagcuaccgucuaugugggcagcgccgaguucacgccgaaacuggggaagguucgguuugaaacagacaccgaggaugaccucgugauccgccagaauaccaaguucacaccugucggagugauucaauccagcgaacaccauagagaugagccccagcaguggcggcugcccaacuacucuggcgccaauaccuuuaacguucaccuugcuccugccguggcgccgaauuuccccggcgagcaacugcucuuuuucagauccacacugccuggguguggaggccaucccaacauggaccuggauugccuccugccucaggaauggguccagcacuuuuaccaggaggcugcccccgcccaaagcgacguggcccuucugcgcuucgugaauccugauacgucucggguucucuuugaauguaaacugcacaagagcggguaugucaccguggcucauacaggacaguacgaccuugugcugcccuccaacggcuauuucagauuugauucuugggucaaccaguucuacacccucgcuccgauggggaauggcacaggacgccggagauga

SEQ ID NO: 30383 - RNA, 1614 nt, Artificial Sequence
  derived and/or modified sequence opt5 from VP1__Norovirus_and/or_Norovirus-like__KF806525
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccuacagcagauuucccaucccgcuugagaaacuguucacagggccuucuuccgccuucgugguucagccccagaacggacgguguaccacagacggcgugcuccuggggaccacgcaacugagcccugucaauauuugcacauuucgcggagaucucacccauuucgcuggcacaucugaauaugcgaugaaccuggccucccagaauuggaccaacuacgaccccaccgaggaaaucccugcuccccuuggcgccccggauuuuguggggaagaucagaggaguccugacacagacgacccggggcgacgggagcacacgcggacacagagccacccucuccacaggcucugcucauuucaccccuaagcuggggagcgugcgguuuuccacggacacaaauaacgauuucgaggccggacagaauaccaaauuuacccccguuggcguguuccaagacggcgauaaccaccagaaugaaccccagcaauggguccuuccuaacuacagcggggcgacagcucacaaugugcaucuggccccggccguugcucccgccuuuccuggagagcagcuccuguucuuucgcucuaccaugcccggcuguuccggguauccuaacaugaaucuggacugccuccugccccaggagugggugcagcacuucuaccaagaagcugccccugcgcagagcgaugucgcccuucugagauuugugaaccccgacacaucucggguucucuucgaguguaagcugcauaaaagcggauaugugacggucgcucacaccggccagcacgaucuugugauuccgccuaauggguacuucagauuugacuccugggugaaccaguucuauacacuggcccccaugggcaacggaaccggccgccggagauga

SEQ ID NO: 30384 - RNA, 1614 nt, Artificial Sequence
  derived and/or modified sequence opt5 from VP1__Norovirus_and/or_Norovirus-like__KC462195
augaagauggccagcaacgacaccauccccuccgauggcucuacagcuaaucuggugccugaggucaacaaugaaguuauggcccucgagccgguggugggggcggcuaucgccgcccccgucgcuggacagcaaaacgugaucgacccuuggauuagaaauaacuucguucaggcccccggcggggaauuuacggugagcccucggaaugcucccggagagauccugugguccaugccucuuucuccggaucugaaccccuaccucagccaccugucccgcauguauaauggcuacgccgggggauucgaaguccaggugauucuugcgggcaacgccuuuaccgcuggcaaaaucaucuucgccgcuauuccucccaauuuuccuacagacgggcugucucccagccagguuaccauguucccgcauaucauuguggaugucagacaacucgagccugugcugaucccccugccugacgugcggaacaauuuuuaucacuacaaccaggucaaugauuccacacucaagcugauugccaugcuuuauacaccccugcgcgcgaacaacgccggagacgauguuuucaccgugagcugcagagugcucacccggcccucuccugacuuugauuucaucuuucuggucccgcccacgguggagucccgcaccaaaccuuucacaguucccauucuuaccguggacgaaaugacaaauagcagauuuccuacgccccuggagcggcuccauaccggcccgaacaauucucuggucgugcagccucagaacgggcgcuguacaaucgauggaguucugcucggcaccacacaacuguccgcugugaauaucugcagcuucagaggggacucuaccacccgggaaggacagucccacgccuacacaaugaaccuugcuagccagaauuggacgaacuaugaccccaccgaggauauuccugcuccccugggcacaccugacuucgucggcaagaucguggggaugcucucccagaccacacgcgaaaauucuagcaccagagcccauaaagccacggucuccacaggagaugcgcacuuuaugcccaagcugggcagcgugcuuuucaccaccgacacagaggaucugcaaaacgggcagaauacccgguuuacaccgguuggaguggcccaggacggcgagccucaccaaaacgaaccccagcaguggcgccuccccaauuacucugggacgccuggacauaacguccaccuggcuccgcccguggccccuaccuuccccggcgagcagcugcucuuuuucagauccacaaugccuggcugugggggauaccccaauauggaucuggacugccuucugccucaagaauggguucggcauuuuuaucaggaggccgcucccgcccagagcgauguggcgcuccugagauucgucaacccggacaccggccgcgugcuuuuugaguguaagcugcacaaagcuggguacauuacagugucucacaccggaccuuaugaucucguuauucccccuaacggcuacuuccgguuugacagcugggucaaucaguucuaugcccuggcccccauggggacgggcaccggaagacgccgguga

SEQ ID NO: 30385 - RNA, 1614 nt, Artificial Sequence
  derived and/or modified sequence opt5 from VP1__Norovirus_and/or_Norovirus-like__AF427116
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccauccccauucugacaguugaggaaauguccaacagcagauuuccuaucccccuugagaagcuguacaccgggccgucuuccgccuucgugguccagccucagaauggacgguguacaaccgauggcgugcuccuggggacgacacaacugagcgccguuaacaucugcaccuuccgcggaaaugugauucauaucgcuggcucucacgacuauacaaugaaccucgcgucccagaauuggaacaauuacgaucccaccgaggaaaccccugcuccccugggcacaagcgacuuugucgggaaaauucagggacuucugacgcagaccacaagagaggacggcuccacccgggcccauaaggccacagugucuaccgggagcguccacuucacgccuaagcucggauccgugcaauacacaaccgauaccaacaaugacuuucagacaggccagaacaccaaauucacacccguuggggugauccaagauggaaauaaccaccagaaugaaccgcagcaguggguccugccuaacuauagcggccgcgccggccauaacgugcaccuugcucccgccguugcgcccacguuuccuggggagcaacuccuguucuuuagaucuaccaugccgggauguuccggcuaccccaauaugaaccuggacugccugcucccucaggaaugggugcagcauuucuaucaggaggcugcccccgcccaaagcgaugucgcucugcuucgguuugugaauccugacacagggcgcgugcuguucgaguguaagcuccacaaaucuggauacguuaccgucgcccacacaggcccccaugaucuggugauuccucccaacggguauuuuagauucgacagcugggugaaucaguuuuacacccuugcuccgaugggcaacggagccggccggagacgcuga

SEQ ID NO: 30386 - RNA, 1614 nt, Artificial Sequence
  derived and/or modified sequence opt5 from VP1__Norovirus_and/or_Norovirus-like__KX514337
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccauccugacggugggggagaugaccaacagcagauuuccugucaaucuugaacggcuguucacaggacccucuuccgccaacgugguucagccgcagaauggccgcuguaccauugauggggagcuccugggaacaacccaacugagcucugugaacaucugcacguucagaggcgacgucacacagaucggcgcuacccggcauuggacaaugaaucucgcguccccuaacuggaauaacuacgaucccaccgaggaaaccccugcuccccuggggacaccugacuuugugggaaagguccacggcaugcuuacgcagaccacacaggggagcggauccacccgcgcccauagagccacaguguauguuggcggggccgaguucacccccaaacugggaaaggugcgguuugaaacggacacagaggaugaccucgucauucgccaaaauaccaaguucaccccggugggcguuauccagucuagcgaacaccacagagaugagccucagcaauggcggcugcccaacuacuccggcgcuaauacauuuaacgugcaucuugcccccgcggucgcuccuaauuucccgggggagcagcugcucuuuuucagaagcacccugcccggauguggcgggcacccuaacauggaccuggauugccuccugccccaggaaugggugcagcauuuuuaccaagaggccgccccugcucagucugacguggcccuucugcgcuucguuaaccccgauacaucccggguccucuuugaauguaaacugcacaagagcggauaugugacgguggcucacaccggccagcaugaccuugucauuccucccaauggguacuucagauuugauucuugggugaaccaguucuauacacuggccccgaugggcaauggaaccggccgcaaacgguga

SEQ ID NO: 30387 - RNA, 1614 nt, Artificial Sequence
  derived and/or modified sequence opt5 from VP1__Norovirus_and/or_Norovirus-like__KX514255
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccauuaaucuugaacggcuguucacaggaccguccagcgcuaacgucgugcagccucagaauggccgcuguaccaucgauggggagcuccugggaacgacacaacugucuuccguuaacaucugcaccuucagaggcgacgugacacauauuggcagcacccaccauuggaccaugaaucucgccucccccaacuggaauaacuacgauccuacagaggaaacgcccgccccucuggggacccccgacuuugucggaaagauccacggcaugcuuacacagaccacacaggagaaugggucuacccgggcucaccgcgcgacgguguaugucggaagcgccgacuucacaccgaaacugggcaaggugcaguuugaaaccgagaccgauuacgaccucgcuauuagacaaaacacaaaguucaccccuguuggggugauccaggaauccgaucaucaccgggacgagccccagcaauggcgccugcccaauuacagcggagccaacacauuuaauguccaucuugccccugcuguggccccgaacuuccccggcgagcagcugcucuuuuucagaucuacgcugccuggcugugggggacaccccaauauggaucuggacugccuccugccucaggaauggguucagcacuuuuaucaagaggcggcucccgcccaguccgauguggcccuucugcgguucgucaacccugacaccagcagagugcucuuugaauguaaacugcauaagucuggcuacgugacaguugcucacaccgggcaguaugaucuuguccugcccagcaacggauacuuccgcuuugacuccugggugaaucaguucuauacacucgccccgaugggcaacgggaccggccggagacgcuga

SEQ ID NO: 30388 - RNA, 1614 nt, Artificial Sequence
  derived and/or modified sequence opt5 from VP1__Norovirus_and/or_Norovirus-like__KX514210
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccgucaaucuugaacggcuguucaccggaccguccagcgccaacgugguucagccucagaauggccgcuguacaauugauggggagcuccugggaaccacgcaacugucuuccgugaacaucugcacauucagaggcgacgucacccauaucggcagcacacaccauuggaccaugaaucucgccucccccaacuggaauaacuacgauccuaccgaggaaacacccgcuccucuggggacgcccgacuuugugggaaagauucacggcaugcuuacccagacaacccaggggucuggaagcacacgggcgcaccgcgccaccgucuaugugggcuccgcugaguucacgccgaaacuggggaagguucaguuuaagacagaaaccgaccaugaucucagcaccagacaaaauacaaaauucaccccugugggagucauccaggagucugaccaccaucgggaugaaccccagcaauggcgccugcccaacuacuccggcgccaauacauuuaacgugcaccuugccccugcuguugccccgaauuuccccggcgagcagcugcucuuuuucagaagcacgcugccuggguguggaggccaccccaacauggaccuggauugccuccugccucaggagugggugcagcauuuuuaccaagaagcggcucccgcccagucugacgucgcccuucugcgguucgugaauccugauaccagcagagugcucuuugaguguaagcugcacaaauccggguauguuacagucgcucauaccggacaguacgaccuugugcugcccucuaacggcuauuuccgcuuugauagcugggugaaccaguucuacacacucgccccgauggggaauggcaccggacggagacgcuga

SEQ ID NO: 30389 - RNA, 1614 nt, Artificial Sequence
  derived and/or modified sequence opt5 from VP1__Norovirus_and/or_Norovirus-like__KX514182
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccgucaaucuugaacggcuguucaccggaccguccagcgccaacgugguucagccucagaauggccgcuguacaauugauggggagcuccugggaaccacgcaacugucuuccgugaacaucugcacauucagaggcgacgucacccauaucggcacaacccagcacuggaccaugaaucucgccagccccaacuggaauaacuacgauccuacagaggaaacgcccgcuccucuggggacccccgacuuugugggaaagauucauggcaugcuuacacagaccacacagggguccggaucuacccgggcgcaccgcgccacggucuaugugggcagcgcugaguucacaccgaaacuggggaagguuagauuugaaaccgacaccgaggaugaccucgugauccggcaaaauacaaaguucaccccugucggagugauucaguccagcgaacaccaucgcgaugagccccagcaauggagacugcccaacuacucuggcgccaauacauuuaacguucaccuugccccugcuguggccccgaauuuccccggcgagcagcugcucuuuuuccgguccacgcugccuggguguggaggccaucccaacauggaccuggauugccuccugccucaggaauggguccagcacuuuuaccaagaggcggcucccgcccagagcgacguggcccuucugagauucgugaauccugauaccucucgcguucucuuugaauguaaacugcacaagagcggguaugucacaguggcucauaccggacaguacgaccuugugcugcccuccaacggcuauuuccgguuugauucuugggucaaccaguucuacacacucgccccgauggggaauggcaccggaagaaaacgcuga

SEQ ID NO: 30390 - RNA, 1614 nt, Artificial Sequence
  derived and/or modified sequence opt5 from VP1__Norovirus_and/or_Norovirus-like__AF425764
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcgggggauuuacagugagcccucggaacgcccccggcgaaauucugugguccgcgccucuugggccggaucugaaucccuaccucucucaccuggcccgcauguauaacggauacgcuggcggcuucgagguccaggugauccuugccgggagcgcuuccacggccggaaaaauuaucuuugcggccguuccucccaauuucccuaccgaaggccugucucccagccaggugacaauguuuccgcauaucauugucgacgugagacaacucgagccugugcugaucccccugccugauguccggaacaauuucuaucacuacaaccaguccaaugacagcaccauuaagcucaucgcuaugcuguauacaccccuucgcgccaacaacgcuggggaugacguuuuuaccgugucuugcagagugcugacacggcccuccccugauuucgacuuuauuuuccucgucccgcccaccguggagagccgcacgaaaccuuuuaccguucccauccugacaguggaagagaugucuaauuccagauucccuauuccccuugaaaagcuguacaccggaccgagcucugccuuugucgugcagccucagaacggccgguguacaaccgaugggguucuccugggaacgacacaacuguccgccgugaauaucugcaccuuccgcggcgacgucacacauaucgcuggcagccacgauuauaccaugaaccucgcgucccagaauuggaacaauuacgaccccaccgaggagauuccugcuccccuggggacaccugacuucgugggaaaaauccagggcaugcuuacgcagaccacaagagaagaugggucuacccgggcccauaaggccacagucagcaccggauccgugcacuuuacgcccaagcugggcagcguucaauacacaaccgacaccaacaaugauuuccagacagggcagaacaccaaauuuacaccggugggagucauucaagacggcaauaaccaccagaaugagccucagcagugggugcuccccaacuauucuggccgcacggggcauaauguucaccuggcccccgcuguggccccuaccuucccgggagaacaacuucuguuuuucagauccacaaugcccggcuguagcggguacccuaacaugaaccucgauugccugcugccccaggaguggguccagcauuuuuaucaggaagcggcuccugcccaaucugacguggcccuccugcgguucgugaaucccgauaccggacgcguucuuuuugaguguaagcugcacaaaagcggcuacgucacaguggcucacaccgggccucaugaccucgugauucccccgaacggcuauuucagauuugauuccugggucaaucaguucuacacgcuggccccuaugggaaacggcgcugggcggagacgcuga

SEQ ID NO: 30391 - RNA, 1614 nt, Artificial Sequence
  derived and/or modified sequence opt5 from VP1__Norovirus_and/or_Norovirus-like__KX514355
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccauuaaucuugaacggcuguucacaggaccguccagcgcuaacgucgugcagccucagaauggccgcuguaccaucgauggggagcuccugggaacgacacaacugucuuccguuaacaucugcaccuucagaggcgacgugacacagauuggcagcacccagcauuggaccaugaaucucgccucccccaacuggaauaacuacgauccuacagaggaaacgcccgccccucuggggacccccgacuuugucggaaagauccacggcaugcuuacacagaccacacaagagaaugggucuacccgggcucaucgcgcgacgguguaugucggaggcgccaacuucacaccgaaacuggggaaggugcaguuugaaaccgacaccagcgaugaccucgcuauuagacagaauacaaaguucaccccuguuggagugauccaauccagcgaucaccaccgggacgagccccagcaguggcgccugcccaacuacucuggcgccaauacauuuaacguccaucuugccccugcuguggccccgaauuuccccggcgaacagcugcucuuuuucagauccacgcugccuggguguggaggccaccccaacauggaucuggacugccuccugccucaagaguggguucagcauuuuuaccaggaggcggcucccgcccagagcgauguggcccuucugcgguucgucaacccugacaccucuagagugcucuuugaauguaaacugcacaagagcggguaugugacaguugcucacaccggacaauacgaucuuguccugcccuccaauggcuauuuccgcuuugacucuugggugaaccaguucuacacacucgccccgauggggaauggcaccggacggagacgcuga

SEQ ID NO: 30392 - RNA, 1614 nt, Artificial Sequence
  derived and/or modified sequence opt5 from VP1__Norovirus_and/or_Norovirus-like__KX514345
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugugaaucuugagcggcuguucaccgggcccuccagcgccaacguugugcagccgcagaauggacgcuguacaaucgauggcgagcuccuggggaccacacaacugucuuccgucaacauuugcaccuucagaggagacgugacgcagaucggcgcuacacggcauuggaccaugaaucucgcgagccugaacuggaauaacuacgauccuacagaagagacccccgccccucuuggcacccccgacuuugucgggaagauccacggaaugcugacacagacgacccagggcuccgggucuacacgcgcucauagagccaccguguauguuggagccgcugaguucacaccuaaacucggcaaggugcgguuugaaaccgacacggaagaugaccuggucauucgccaaaauacaaaguucacccccguggggguuauccagagcuccgagcaccacagagaugagccgcagcaauggcggcuuccuaacuacagcggagccaauaccuuuaacgugcaucuggcgcccgcugucgcccccaauuucccuggcgaacagcuccuguuuuucagaucuacacugccgggcugugggggacaccccaacauggaccucgauugccugcuuccucaggagugggugcagcauuuuuaccaagaagccgcucccgcccaguccgacguggcucugcuccgcuucguuaacccugauaccagccggguccuguuugaguguaaacuucacaagucuggcuaugugacaguggcccacacggggcaguacgaccugguccuccccagcaauggauauuucagauuugauuccugggugaaccaguucuacacccuggcgccuaugggcaaugggacaggccgccggagauga

SEQ ID NO: 30393 - RNA, 1614 nt, Artificial Sequence
  derived and/or modified sequence opt5 from VP1__Norovirus_and/or_Norovirus-like__KX514204
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaacggcuguucaccggaccguccagcgccaacgucgugcagccucagaauggccgcuguacaaucgauggggagcuccugggaaccacgcaacugucuuccguuaacaucugcacauucagaggcgacgugacccauauuggcagcacacaccauuggaccaugaaucucgccucccccaacuggaauaacuacgauccuaccgaggaaacacccgcuccucuggggacgcccgacuuugucggaaagauccacggcaugcuuacccagacaacccaggggucuggaagcacacgggcgcaccgcgccaccguguaugucggcggggcugaguucacgccgaaacugggaaaggugcaguuuaagacagaaaccgaccaugaucucuccauuagacaaaauaccaaauucacaccuguuggcgugauccaggagagcgaccaccaucgggaugaaccccagcaauggcgccugcccaacuacucuggcgccaauaccuuuaacguccaccuugccccugcuguggccccgaauuuccccggggagcagcugcucuuuuucagauccacacugccuggauguggcgggcaccccaacauggaccuggauugccuccugccucaggaguggguucagcauuuuuaccaagaagcggcucccgcccagagcgacguggcccuucugcgguucgucaauccugauacgucuagagugcucuuugaguguaagcugcacaaaagcggauaugugaccguugcucauacaggccaguacgaccuuguccugcccuccaacggguauuuccgcuuugauucuugggugaaccaguucuacacccucgccccgaugggcaauggaacaggccggagacgcuga

SEQ ID NO: 30394 - RNA, 1614 nt, Artificial Sequence
  derived and/or modified sequence opt5 from VP1__Norovirus_and/or_Norovirus-like__KF712492
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucauugacccuuggaucagaaauaacuucgugcaggcccccggcggggaauuuacaguuuccccucggaaugcgcccggagagauucuguggucugccccucuuggcccggaucugaaccccuaccucagccaccugucccgcauguauaauggguacgcuggaggcuucgaagugcaggucauccuugccggcaacgcuuuugccgcggggaaaauuaucuucgccgcugugccucccaauuuuccuacggagggacugucucccagccagguuaccauguucccgcaucucaucguggacgucagacaacuggagccugugaugauuccccugccugauauccggaacaauuuuuaucacuacaaccaguccaaugaccccacaauuaagcucaucgccaugcuguauacaccccuucgcgcuaacaacgugggcgaugacgucuucaccguuagcugcagagugcugacccggccuucuccggauuuugacuucauuuuucucgugcccccuacagucgaauccaaaaccaaucccuucagcgugccuauccugacgauugaggaaaugaccaacucucgcuuucccaucccgcuugagaagcuguucacagggccuuccagcgcccucguugugcagccccagaauggaagauguaccacagauggcguccugcuggggaccacgcaacucucuccugugaacaucugcacauuccggggagacguuacccauacaaccaaaacccacacauaccagaugaaucuggccgcucagaacuggaacuccuaugaucccacggaggaaauuccugcgccccuuggcaccccggacuuugugggcaagauccaggggguccugacacaaaccacaaagggaaauggcagcacccgcgcccauaaagcuacgguguacacaggguccgccgaguucaccccuaagcucggacggauucagcuguuuaccgacacagauaaugaccuugaagccaaccagaauaccaaauucacacccgucggcgugauccaagauggggacacgcaccagaacgagccccagcaguggguucugccuucuuacagcggaagaaauaaccacaaugugcaucucgcuccggccgucgcgcccaccuuuccuggcgaacaacugcuguucuuucgcuccacaaugcccggcuguagcggguauccuaacaugaaccucgauugccugcuuccccaggagugggugcaguacuucuaucaggaggcugccccugcccaaucugacguugcucugcucagauuugugaaucccgauaccggacggguccuguucgaauguaaacuucacaaguccggcuacgugacaguggcccauaccgggcaccacgaccuguuuauuccgccuaacggauauuuccgcuuugauagcuggguuucucccuucuacacgcucgcuccuaugggcaaugggaccggcagacggagauga

SEQ ID NO: 30395 - RNA, 1614 nt, Artificial Sequence
  derived and/or modified sequence opt5 from VP1__Norovirus_and/or_Norovirus-like__DQ078829
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuacccuucucaccucgcucgcauguauaacggguacgccggaggcuucgaaguccaggugauccuggcuggcaaugccuuuacagcggggaaaauuaucuucgccgcuguucccccuaacuuucccacggagggacuuagcccgucccaggugaccauguucccucauaucauugucgacgugagacaacuggaucccgugcucaucccuucucccgacguccggaauaacuuuuaucacuacaaucagagcaacgauuccacaauuaagcugaucgccaugcuguauacaccccuccgcgcuaacaaugccggcgacgauguuuucaccgugagcugcagagugcugacccggccuucuccggacuuugauuucauuuuucuugugcccccuacagucgagucccgcaccaaacccuucacgguuccuauccugaccguggaagagaugagcaacucuagauuucccauuccgcucgaaaagcuguacacagggccuuccagcgccuucgucgugcagccccagaauggacgguguaccacagacggcguucuucuggggaccacgcaacucucugcugugaacaucugcacauuccgcggagaugucacccauaucgcgggcucccacgacuauacaaugaaucuggccagccagaacuggauuaauuacgacccuaccgaggagauccccgcuccucugggcacccccgauuuuguggggaaaauucagggaaugcucacacagacgaccagagaagacggcuccacacgggcccauaaggccaccgucucuacagggagcgugcacuucaccccgaagcugggauccguucaauacacgacagauaccaacaaugacuuucagaccggccaggauacaaaauucaccccugugggggucauccaagacggaaacaaucaccagaacgagccccagcagugggugcuucccaauuauagcggccgcacaggccauaacguucaccuggcuccugccguggcgccgacguuucccggggaacaacuccuguucuuuagaucuaccaugccuggauguuccggcuaccccaauaugaaccuugauugccugcucccucaggaguggguccagcauuucuaucaggaagcugcccccgcccaaccugacguggcucugcugcgguuugugaaccccgauacagggcgcguucucuucgaguguaagcugcacaaaagcggauacgucaccguggcccacacaggcccgcaugaccuugugauuccucccaauggguauuuuagauucgauucuugggucaaccaguuuuacacccuggcuccuaugggcaauggagccggccggagacgcuga

SEQ ID NO: 30396 - RNA, 1614 nt, Artificial Sequence
  derived and/or modified sequence opt5 from VP1__Norovirus_and/or_Norovirus-like__KX514370
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaaccccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaauagcagauuucccgucaaccuugaacggcuguucaccggaccgucuuccgccaaugugguucagccucagaacggccgcuguacaauugauggggagcuccugggaaccacgcaacugagcucugugaauaucugcacauucagaggcgacgucacccagaucggcgccacacggcauuggaccaugaaccucgcuucccccaauuggaacaauuacgauccuaccgaggaaacacccgcgccucuggggacgcccgacuuugugggaaagauucacggcaugcuuacccagacaacccaggggagcggauccacacgcgcccauagagcuaccgucuaugugggcggggccgaguucacgccgaaacugggaaagguucgguuugaaacagacaccgaggaugaccucgugauccgccaaaacaccaaguucacaccugucggcgugauucagucuagcgaacaccacagagaugagccccagcaauggcggcugcccaauuacuccggcgccaacaccuuuaauguucaucuugcuccugccguggcgccgaacuuccccggggagcagcugcucuuuuucagaagcacacugccuggauguggcgggcaccccaauauggaccuggauugccuccugccucaggaauggguccagcauuuuuaccaagaggcugcccccgcccagucugacguggcccuucugcgcuucgugaacccugauacgucccggguucucuuugaauguaaacugcacaagagcggauaugucaccguggcucacacaggccaguacgaccuugugcugcccucuaacggguauuucagauuugauagcugggucaaucaguucuacacccucgcuccgaugggcaacggaacaggccgccggagauga

SEQ ID NO: 30397 - RNA, 1614 nt, Artificial Sequence
  derived and/or modified sequence opt5 from VP1__Norovirus_and/or_Norovirus-like__KX514332
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccauuaaucuugaacggcuguucacaggaccguccagcgcuaacgucgugcagccucagaauggccgcuguaccaucgauggggagcuccugggaacgacacaacugucuuccguuaacaucugcaccuucagaggcgacgugacacagauuggcagcaccaagcauuggaccaugaaucucgccucccccaacuggaauaacuacgauccuacagaggaaacgcccgccccucuggggacccccgacuuugucggaaaaauccacggcaugcuuacacagaccacacaggagaaugggucuacccgggcucaucgcgcgacgguguaugucggaggcgccaacuucacaccgaagcuggggaaggugcaauuugaaaccgacaccguugaugaccucgagauuagacagaauacaaaauucaccccugugggagucauccagagcuccgaucaccaccgggacgaaccccaacaguggcgccugcccaacuacagcggcgcuaauacauuuaacgugcaucuugccccugccguugcuccgaauuuccccggcgagcagcugcucuuuuucagaucuacgcugccuggguguggaggccaccccaacauggaucuggacugccuccugccucaggagugggugcaacauuuuuaccaggaagccgcgcccgcucaguccgaugucgcccuucugcgguucgugaacccugacaccagcagagugcucuuugaguguaagcugcacaaaucuggguauguuacagucgcccacaccggacaguacgaucuugugcugcccagcaauggcuauuuccgcuuugacuccugggugaaccaauucuacacacucgcuccgauggggaauggcaccggacggagacgcuga

SEQ ID NO: 30398 - RNA, 1614 nt, Artificial Sequence
  derived and/or modified sequence opt5 from VP1__Norovirus_and/or_Norovirus-like__KX514276
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccgucaaucuugaacggcuguucaccggaccguccagcgccaacgugguucagccucagaauggccgcuguacaauugauggggagcuccugggaaccacgcaacugucuuccgugaacaucugcacauucagaggcgacgucacccauaucggcacaacccaccauuggaccaugaaucucgccagccccaacuggaauaacuacgauccuacagaggaaacgcccgcuccucuggggacccccgacuuugugggaaagauucacggcaugcuuacacagaccacacagggguccggaucuacccgggcgcaccgcgccacggucuaugugggcagcgcugaguucacaccgaaacuggggaagguuagauuugaaaccgacaccgaggaugaccucgugauccggcagaauacaaaguucaccccugucggagugauucaauccagcgaucaucaccgcgacgaaccccagcaguggagacugcccaacuacucuggcgccaauacauuuaacguucaucuugccccugcuguggccccgaauuuccccggcgagcaacugcucuuuuuccgguccacgcugccuggguguggaggccaccccaacauggaucuggacugccuccugccucaggaguggguccagcacuuuuaccaggaagcggcucccgcccaaagcgauguggcccuucugagauucgugaauccugacaccucucgcguucucuuugaguguaaacugcauaagagcggguaugucacaguggcucacaccggacaguacgaucuugugcugcccuccaacggcuauuuccgguuugacucuugggucaaccaguucuacacacucgccccgauggggaauggcaccggaagacgccgguga

SEQ ID NO: 30399 - RNA, 1614 nt, Artificial Sequence
  derived and/or modified sequence opt5 from VP1__Norovirus_and/or_Norovirus-like__KX514256
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaaggacuguucaccggcccguccagcgccaacgucgugcagccucagaaugggcgguguacaaucgauggagagcuccugggcaccacgcaacugucuuccguuaacaucugcacauuccgcggcgacgugacccauauugggagcacacaccauuggaccaugaaucucgccucccccaacuggaacucuuacgauccuaccgaggaaacacccgcuccucugggaacgcccgacuuugucggcaagauccacgggaugcuuacccagacaacccagggaagcggcuccacaagagcgcaccgggccaccguguaugucgggagcgcugaguucacgccgaaacugggaaaggugcaguuuaagacagaaaccaaucaugaccucucuauucgccaaaauaccaaauucacaccuguuggcgugauccaggaguccgaucaccauagagacgaaccccagcaauggcggcugcccaacuacagcggcgccaauaccuuuaacguccaccuugccccugcuguggccccgaauuuccccggggagcagcugcucuuuuuccgcucuacacugccuggauguggcgggcaccccaacauggaucuggacugccuccugccucaggaguggguucagcauuuuuaccaagaagcggcucccgcccagagcgauguggcccuucugagauucgucaauccugacacgucccgggugcucuuugaguguaagcugcacaaaucuggauaugugaccguugcucauacaggccaguacgaucuuguccugcccccgaacggguauuucagauuugacagcugggugaaccaguucuacacccucgccccuaugggcaauggaacaggccgccggagauga

SEQ ID NO: 30400 - RNA, 1614 nt, Artificial Sequence
  derived and/or modified sequence opt5 from VP1__Norovirus_and/or_Norovirus-like__KX514209
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugaccucauuuuccuggugcccccuaccgucgaaucccgcacgaaacccuuuagcguuccuauccuuaccgugggggagaugacaaacucuagauuccccgucaaucuggaacggcucuuuaccggaccguccagcgccaacgugguucagccucagaauggccgcuguacaauugauggggagcugcugggaaccacgcaacucucuuccgugaacaucugcacauucagaggcgacgucacccauaucggcagcacacaccauuggaccaugaaucuggccucccccaacuggaauaacuacgauccuaccgaggaaacacccgcuccucuugggacgcccgacuucgugggaaagauucacggcaugcugacccagacaacccaggggucuggaagcacacgggcgcaccgcgccaccgucuaugugggcuccgcugaguuuacgccgaaacucgggaagguucaguucaagacagaaaccgaccaugaucugagcaucagacaaaauaccaaauuuacaccugugggagucauucaggagucugaccaccaucgggaugaaccccagcaauggcgccuucccaacuacuccggcgccaauaccuucaacgugcaccuggccccugcuguugccccgaauuuucccggcgagcagcuccuguucuuuagaagcacacugccuggguguggaggccaccccaacauggaccucgauugccugcuuccucaggagugggugcagcauuucuaccaagaagcggcucccgcccagucugacgucgcccugcuccgguuugugaauccugauacgagcagagugcuguucgaguguaaacuucacaaguccggguauguuaccgucgcucauacaggacaguacgaccuggugcuccccucuaacggcuauuuucgcuucgauagcugggugaaccaguuuuacacccuggccccgauggggaauggcacaggacggagacgcuga

SEQ ID NO: 30401 - RNA, 1614 nt, Artificial Sequence
  derived and/or modified sequence opt5 from VP1__Norovirus_and/or_Norovirus-like__KX514205
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaacggcuguucaccggaccguccagcgccaacgucgugcagccucagaauggccgcuguacaaucgauggggagcuccugggaaccacgcaacugucuuccguuaacaucugcacauucagaggcgacgugacccauauuggcagcacacaccauuggaccaugaaucucgccucccccaacuggaauaacuacgauccuaccgaggaaacacccgcuccucuggggacgcccgacuuugucggaaagauccacggcaugcuuacccagacaacccaggggucuggaagcacacgggcgcaccgcgccaccguguaugucggcggggcugaguucacgccgaaacugggaaaggugcaguuuaagacagaaaccgaccaugaucucuccauuagacaaaauaccaaauucacaccuguuggcgugauccaggagagcgaccaccaucgggaugaaccccagcaauggcgccugcccaacuacucuggcgccaauaccuuuaacguccaccuugccccugcuguggccccgaauuuccccggggagcagcugcucuuuuucagauccacacugccuggauguggcgggcaccccaacauggaccuggauugccuccugccucaggaguggguucagcauuuuuaccaagaagcggcucccgcccagagcgacguggcccuucugcgguucgucaauccugauacgucuagagugcucuuugaguguaagcugcacaaaagcggauaugugaccguugcucauacaggccagcacgaccuugucauucccccgaacggguacuuccgcuuugauuccugggugaaccaguucuauacccuggccccuaugggcaauggaacaggccggagacgcuga

SEQ ID NO: 30402 - RNA, 1614 nt, Artificial Sequence
  derived and/or modified sequence opt5 from VP1__Norovirus_and/or_Norovirus-like__KX514200
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaacggcuguucaccggaccguccagcgccaacgucgugcagccucagaauggccgcuguacaaucgauggggagcuccugggaaccacgcaacugucucccguuaacaucugcacauucagaggcgacgugacccauauuggcacaacccggcacuggaccaugaaucucgccuccccuaacuggaauaacuacgaucccacagaggaaacgccugcuccccuggggaccccggacuuugucggaaagauccauggcaugcuuacacagaccacacaggggagcggauccacccgcgcgcacagagccacgguguaugucggcucugcugaguucacaccuaaacuggggaaggugcaguuuaagaccgaaaccgaccacgaucucagcauucggcaaaauacaaaauucacccccguuggagugauccagaaguccgaccaucaccgcgaugagccccagcaauggagacugccuaacuacagcggcgccaauacauuuaacguccaucuugccccggcuguggcccccaauuucccuggcgaacagcugcucuuuuuccggucuacgcugcccggguguggaggccacccuaacauggaccuggauugccuccugccccaggaguggguucagcacuuuuaccaagaggcggcuccugcccaguccgacguggcccuucugagauucgucaaucccgauaccagccgcgugcucuuugaauguaaacugcauaagucuggguaugugacaguugcucacaccggacaguacgaccuuguccugccgagcaacggcuauuuccgguuugauuccugggugaaccaguucuacacacucgccccuauggggaauggcaccggaagacgccgguga

SEQ ID NO: 30403 - RNA, 1614 nt, Artificial Sequence
  derived and/or modified sequence opt5 from VP1__Norovirus_and/or_Norovirus-like__KX514196
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacguuuuuacagccgggaaaauuaucuucgcggccgugccucccacguuuccuaccgagggacugucccccucucaggucacaauguucccgcauaucauuguggacgugagacaacucgagccuguccugaucccccugccugauguucggaauaacuuuuaucacuacaaucagagcaacgacuccaccauuaagcucaucgcuaugcuguauacaccccuucgcgccaauaaccccggcgaugacguguucaccgugagcugcagaguccugacacggccuucuccggauuuugacuucauuuuucucgugcccccuaccguugaaucccgcacgaaacccuucagcgugccuauccugaccgucggggagaugacaaacucuagauuucccauuaaucuugaacggcuguucaccggaccguccagcgcuaacgugguucagccucagaauggccgcuguacaaucgauggggagcuccugggaaccacgcaacugucuuccgugaacaucugcacauucagaggcgacgucacccauauuggcagcacacaccauuggaccaugaaucucgccucccccaacuggaauaacuacgauccuaccgaggaaacacccgccccucuggggacgcccgacuuugugggaaagauccacggcaugcuuacccagacaacccaggggucuggaagcacacgggcucaccgcgcgaccgucuaugugggcggggccgaguucacgccgaaacugggaaagguucaguuuaagacagaaaccgaccaugaucucaccauuagacaaaauacaaaauucaccccugugggcgucauccaggaguccgaccaccaucgggaugaaccccagcaauggcgccugcccaacuacagcggcgcuaauacauuuaacgugcaccuugccccugccguugcuccgaauuuccccggggagcagcugcucuuuuucagaucuacgcugccuggauguggcgggcaccccaacauggaccuggauugccuccugccucaggagugggugcagcauuuuuaccaagaagccgcgcccgcucaguccgacgucgcccuucugcgguucgugaauccugauaccagcagagugcucuuugaguguaagcugcacaaaucuggauauguuacagucgcccauaccggccaguacgaccuugugcugcccagcaacggguauuuccgcuuugauuccugggugaaccaguucuacacacucgcuccgaugggcaauggaaccggccggagacgcuga

SEQ ID NO: 30404 - RNA, 1614 nt, Artificial Sequence
  derived and/or modified sequence opt5 from VP1__Norovirus_and/or_Norovirus-like__AB985437
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccugagccgcauguauaacggguacgcuggaggcuucgaaguccaggugauccuugccggcaaugcuuuuacagccgggaaaguuauuuucgcggccgugccucccaacuuuccuacggagggacugucccccucucaggucaccauguucccgcauaucaucguggacgugagacaacucgagccuguccugauuccccugccugauguucggaauaacuuuuaucacuacaaucaggcucaugacagcacacucaagcugaucgccaugcuuuauacaccccugcgcgcuaacaacgccggcgaugacguguucaccguguccugcagaguccucacccggcccagcccugauuuugacuucauuuuucuggugccgcccacaguugaaucucgcaccaaaccuuucacggugcccauccuuaccgucgaggaaauguccaauagcagauuuccuauuccccuggagaagcucuacacagggccgucuuccgccuucgugguucagccucagaacggacgguguaccacagauggcgugcugcuggggaccacgcaacucagcgcugucaauaucugcaacuuccgcggagacgugacacacauugucggcucucaugauuauaccaugaaucuggugucccagaacuggaauaacuacgaccccacagaggaaaucccugcgccccuuggcaccccugacuuuguugggaaaauccagggacugcucacccagacaacgagagccgauggcagcacccgggcucacaaggccacaguguccaccgggucuguccacuucacacccaagcugggaagcgugcaauuuaccacggacacaaauaacgauuuccagaccggccagaauaccaaauuuacaccgguuggggugauucaagacggagaucaucaccagaacgagccucagcaguggguccuucccaauuacuccggcaccagcggccauaacgugcaccuggcccccgcuguggccccuacauucccgggggaacaacuccuguuuuuccgcucuacgaugcccggauguuccggcuauccuaauaugaaccuggacugccuccugccccaggaguggguucuucacuuuuaccaggaagcggcuccugcccagagcgaugucgcccugcucagauucgugaaccccgacaccgggcgggugcuguuugaguguaaacuucauaagucuagcuauaucacagucgcucacaccggaccuuacgaucuggugauucccccgaauggcuauuuccgcuuugacuccuggguuaaccauuucuacacacucgccccuauggggaauggcaccggaggcagacgguga

SEQ ID NO: 30405 - RNA, 1614 nt, Artificial Sequence
  derived and/or modified sequence opt5 from VP1__Norovirus_and/or_Norovirus-like__KF712494
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucauugacccuuggaucagaaauaacuucgugcaggcccccggcggggaauuuacaguuuccccucggaaugcgcccggagaggugcuguggucugccccucuuggcccggaucugaaccccuaccucagccaccuggcucgcauguauaauggguacgccggaggcuucgaaguccaggugauucuugcuggcaacgccuuugcggccgggaaaaucauuuucgcugccguuccucccaauuuuccuacggagggacugucccccucucaggugaccauguucccgcaucucaucaucgacgucagacaacuggagccugugaugauuccccugccugaugugcggaacaauuuuuaucacuacaaccagagcaaugaccccacaaucaagcucauugcuaugcuguauacaccccuucgcgccaacaacgucggcgaugacguuuucaccguguccugcagagugcugacccggccuagcccggauuuugacuucaucuuucucgugcccccuacagucgaaucuaaaaccaaucccuucuccguuccuauucugacgaucgaggaaaugaccaacagccgcuuucccauuccgcuugagaagcuguucacagggccuucuuccgcccucgugguccagccccagaauggaagauguaccacagauggcgugcugcuggggaccacgcaacucagcccuguuaacaucugcacauuccggggagacgugacccauaucacaaaaacccacucuuaccagaugaaucuggcugcgcagaacuggaacuccuaugaucccaccgaggaaauuccugcuccccuuggcacaccggacuuugucggcaagauccagggggugcugacgcaaaccacaaagggaaauggcagcacccgcgcccauaaagccacagucuacaccggguccacggaguucacaccuaagcucggacggauucagcuggugaccgacaccgauaaugaccuugaaacaaaccagaauaccaaauuuacacccguuggcgugauccaagauggggacacgcaccagaacgagccccagcaguggguccugccuucuuaccucggaagaaauaaccacaaugugcaucuggccccggcuguugcccccaccuucccuggcgaacaacugcucuuuuuccgcagcacaaugcccggcuguuccggguauccuaacaugaaccuggauugccuucugccccaggagugggugcaguacuuuuaucaggaggcggcuccugcccaaagcgacgucgcccuccugagauucgugaaucccgauaccggacgggugcuuuuugaauguaagcugcacaaaucuggcuacguuacagucgcucauaccgggcaccacgaccucuucauuccgccuaacggauauuuucgcuucgauuccugggugagccccuuuuacacgcuggccccuaugggcaaugggaccggcagacggagauga

SEQ ID NO: 30406 - RNA, 1614 nt, Artificial Sequence
  derived and/or modified sequence opt5 from VP1__Norovirus_and/or_Norovirus-like__KX514315
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaauucuagauuucccauuaaccuugaacggcuguucaccggaccguccagcgcuaaugucgugcagccucagaacggccgcuguacaaucgauggggagcuccugggaaccacgcaacugucuuccguuaauaucugcacauucagaggcgacgugacccagauuggcagcacaaagcauuggaccaugaaccucgccucccccaauuggaacaauuacgauccuaccgaggaaacacccgccccucuggggacgcccgacuuugucggaaaaauccacggcaugcuuacccagacaacccaggagaacgggucuacacgggcucaucgcgcgaccguguaugucggaggcgccaauuucacgccgaagcuggggaaggugcaauuugaaacagacaccggagaugaccucgcuauuagacagaacaccaaauucacaccuguuggcgugauccagagcuccgaucaccaccgggacgagccccaacaguggcgccugcccaauuacagcggcgccaacaccuuuaauguccaucuugccccugcuguggccccgaacuuccccggggaacagcugcucuuuuucagaucuacacugccuggauguggcgggcaccccaacauggaucuggacugccuccugccucaggaguggguucaacauuuuuaccaggaggcggcucccgcccaguccgauguggcccuucugcgguucgucaauccugacacgagcagagugcucuuugaauguaagcugcacaaaucuggauaugugaccguugcucacacaggccaguacgaucuuguccugcccagcaacggguauuuccgcuuugacuccugggugaaucaauucuacacccucgccccgaugggcaacggaacaggccggagacgcuga

SEQ ID NO: 30407 - RNA, 1614 nt, Artificial Sequence
  derived and/or modified sequence opt5 from VP1__Norovirus_and/or_Norovirus-like__KX514199
augaagauggccagcuccgacgcuaaccccucugauggcagcgccgcgaaucuggugccugaggucaacaaugaaguuauggcucucgagccgguggugggggccgccaucgucgcucccguggccggacagcaaaacguuauugacccuuggaucagaaauaacuucgugcaggcucccggcggggaauuuaccgucuccccucggaaugcccccggagagauucuguggucugcgccucuuggcccggaucugaaccccuaccucagccaccuggcccgcauguauaauggguacgcuggaggcuucgaagugcagguuauccuugccggcaacgcuuuuacagccgggaaaauuaucuucgcggccgugccucccacguuuccuaccgagggacugucccccucucaggucacaauguucccgcauaucauuguggacgugagacaacucgagccuguccugaucccccugccugauguucggaauaacuuuuaucacuacaaucagagcaacgacuccaccauuaagcucaucgcuaugcuguauacaccccuucgcgccaauaaccccggcgaugacguguucaccgugagcugcagaguccugacacggccuucuccggauuuugacuucauuuuucucgugcccccuaccguugaaucccgcacgaaacccuucagcgugccuauccugaccgucggggagaugacaaacucuagauuucccauuaaucuugaacggcuguucaccggaccguccagcgcuaacgugguucagccucagaauggccgcuguacaaucgauggggagcuccugggaaccacgcaacugucuuccgugaacaucugcacauucagaggcgacgucacccauauuggcagcacacaccauuggaccaugaaucucgccucccccaacuggaauaacuacgauccuaccgaggaaacacccgccccucuggggacgcccgacuuugugggaaagauccacggcaugcuuacccagacaacccaggggucuggaagcacacgggcucaccgcgcgaccgucuaugugggcuccgccgaguucacgccgaaacuggggaagguucaguuuaagacagaaaccgaccaugaucucaccauuagacaaaauacaaaauucaccccugugggagucauccaggagagcgaccaccaucgggaugaaccccagcaauggcgccugcccaacuacucuggcgcuaauacauuuaacgugcaccuugccccugccguugcuccgaauuuccccggcgagcagcugcucuuuuucagauccacgcugccuggguguggaggccaccccaacauggaccuggauugccuccugccucaggagugggugcuucauuuuuaccaggaagccgcgcccgcucaaagcgacgucgcccugcuccgguucgugaauccugauaccucuagagugcuguuugaguguaaacuucacaagagcggguauguuacagucgcccauaccggacaguacgaccuggugcuccccuccaacggcuauuuccgcuuugauucuugggugaaccaguucuacacacuggcuccgauggggaauggcaccggacggagacgcuga

SEQ ID NO: 30408 - RNA, 1614 nt, Artificial Sequence
  derived and/or modified sequence opt5 from VP1__Norovirus_and/or_Norovirus-like__KX514176
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccgucaaucuugaacggcuguucaccggaccguccagcgccaacgugguucagccucagaauggccgcuguacaauugauggggagcuccugggaaccacgcaacugucuuccgugaacaucugcacauucagaggcgacgucacccggaucggcacaacccagcauuggaccaugaaucucgccagccccaacuggaauaacuacgauccuacagaggaaacgcccgcuccucuggggacccccgacuuugugggaaagauucacggcaugcuuacacagaccacacagggguccggaucuacccgcgcgcauagagccacggucuaugugggcagcgcugaguucacaccgaaacuggggaagguucgguuugaaaccgacaccgaggaugaccucgugauccgccaaaauacaaaguucaccccugucggagugauucaguccagcgaacaccacagagaugagccccagcaauggcggcugcccaacuacucuggcgccaauacauuuaacguucaucuugccccugcuguggccccgaauuuccccggcgagcagcugcucuuuuucagauccacgcugccuggguguggaggccaccccaacauggaccuggauugccuccugccucaggaauggguccagcauuuuuaccaagaggcggcucccgcccagagcgacguggcccuucugcgcuucgugaauccugauaccucucggguucucuuugaauguaaacugcacaagagcggguaugucacaguggcucacaccggacaguacgaccuugugcugcccuccaacggcuauuucagauuugauucuugggucaaccaguucuacacacucgccccgauggggaauggcaccggacgccggagauga

SEQ ID NO: 30409 - RNA, 1614 nt, Artificial Sequence
  derived and/or modified sequence opt5 from VP1__Norovirus_and/or_Norovirus-like__KX514360
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccauuaaucuugaacggcuguucacaggaccguccagcgcuaacgucgugcagccucagaauggccgcuguaccaucgauggggagcuccugggaacgacacaacugucuuccguuaacaucugcaccuucagaggcgacgugacacagauuggcagcaccaagcauuggaccaugaaucucgccucccccaacuggaauaacuacgauccuacagaggaaacgcccgccccucuggggacccccgacuuugucggaaaaauccacggcaugcuuacacagaccacacaggagaaugggucuacccgggcucaucgcgcgacgguguaugucggaggcgccaacuucacaccgaagcuggggaaggugcaauuugaaaccgacaccggagaugaccucgcuauuagacagaauacaaaauucaccccuguuggcgugauccagagcuccgaucaccaccgggacgagccccaacaguggcgccugcccaacuacagcggcgccaauacauuuaacguccaucuugccccugcuguggccccgaauuuccccggggaacagcugcucuuuuucagaucuacgcugccuggauguggcgggcaccccaacauggaucuggacugccuccugccucaggaguggguucaacauuuuuaccaggaggcggcucccgcccaguccgauguggcccuucugcgguucgucaacccugacaccagcagagugcucuuugaauguaagcugcacaaaucuggauaugugacaguugcucacaccggccaguacgaucuuguccugcccagcaauggguauuuccgcuuugacuccugggugaaccaauucuacacacucgccccgaugggcaauggaaccggccggagacgcuga

SEQ ID NO: 30410 - RNA, 1614 nt, Artificial Sequence
  derived and/or modified sequence opt5 from VP1__Norovirus_and/or_Norovirus-like__KX514347
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaguccggcaauaccaaaaucuacacaaugaaccucgcuagccccaauuggaacaauuaugacccuaccgaggagauccccgcgccucugggcacccccgacuucgucgggaagauucauggaaugcuuacacagacgacccagggcuccgggucuacaagagcccaccgggcuaccguguacguuggaggcgccgaauuuacaccgaagcuggggaaagugcgcuucgagaccgauacggaagacgaucucgucaucagacaaaacacaaaguuuaccccugugggaguuauucagagcuccgagcaucaccgggacgaaccccagcaauggcgccugcccaauuacagcggcgccaacaccuucaaugugcaccuugcuccugccgucgcgccgaacuuucccggcgagcagcuucucuucuuuagaucuacacugccuggguguggaggccaucccaauauggaucuggacugccuccugccucaggagugggugcagcacuucuaucaagaagcugcccccgcccaguccgauguggcucugcugcgguuuguuaacccugacaccagcagaguccucuucgaguguaaacugcauaagucuggguacgugacaguggcccacacgggacagcacgaucuuguccugcccagcaacggcuauuuucgcuucgacuccugggugaaucaguucuacacccucgcuccgauggggaacggcacaggacggagacgcuga

SEQ ID NO: 30411 - RNA, 1614 nt, Artificial Sequence
  derived and/or modified sequence opt5 from VP1__Norovirus_and/or_Norovirus-like__AB684675
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacauuaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccaggcucaugacuccacacucaagcugauugccaugcuuuauacaccccugcgcgcuaauaacgccggcgaugacguuuucaccgugagcugcagagugcucacccggcccucuccugauuuugacuucaucuuucuggucccgcccacaguggaaucccgcaccaaaccuuucacgguucccauucuuaccguggaggaaaugagcaacucuagauuuccuaucccccuggagaagcucuacacagggccguccagcgccuucgucgugcagccucagaauggacgguguaccacagauggcguucugcuggggaccacgcaacucucugcugugaacauuugcaauuuccugggagacgucacacgcgugggcaccucccacgauuauacaaugaaccuugucagccagaauugggacaacuacgaccccaccgaggaaaucccugcgccccugggcaccccugauuuuguggggaaaauccagggacuccugacacagacgaccagagccgaccgguccacacccgcucauaaggccaccguuucuacaggcagcgugcacuucaccccgaaacuuggguccguccaauuuacgacagauaccaauaacgacuuccagaccggacagaauacaaaguuuaccccugugggcguuauucaagauagcgaccaccaucagaacgagccccagcagugggugcugcccaauuacucugggacaacgggacacaacguccaucucgccccugcuguggccccgaccuuccccggcgaacaacugcuguuuuuccgcgugacaaugccuggcuguuccggguaucccaauaugaaccucgauugccugcuuccucaggaguggguucugcacuuuuaccaggaagcggcucccgcccagagcgacgucgcccuccugagauucgugaauccugauaccggacgggugcuuuuugaguguaagcugcacaaaucuggcuauaucacagucgcucauaccgggcccuacgaccucgugauuccgccuaacggauauuuccgcuuugauagcuggguuaaccaauucuacacgcuggcccccaugggcaaugggaccggcagacggagauga

SEQ ID NO: 30412 - RNA, 1614 nt, Artificial Sequence
  derived and/or modified sequence opt5 from VP1__Norovirus_and/or_Norovirus-like__KX514369
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccgucaaucuugaacggcuguucaccggaccguccagcgccaacgugguucagccucagaauggccgcuguacaauugauggggagcuccugggaaccacgcaacugucuuccgugaacaucugcacauucagaggcgacgucacccagaucggcgccacacggcauuggaccaugaaucucgcuagccccaacuggaauaacuacgauccuaccgaggaaacacccgcgccucuggggacgcccgacuuugugggaaagauucacggcaugcuuacccagacaacccagggguccggaucuacacgcgcccauagagcuaccgucuaugugggcggggccgaguucacgccgaaacugggaaagguucgguuugaaacagacaccgaggaugaccucgugauccgccaaaauaccaaguucacaccugucggcgugauucagagcuccgaacaccacagagaugagccccagcaauggcggcugcccaacuacagcggcgccaauaccuuuaacguucaucuugcuccugccguggcgccgaauuuccccggggagcagcugcucuuuuucagaucuacacugccuggauguggcgggcaccccaacauggaccuggauugccuccugccucaggaauggguccagcauuuuuaccaagaggcugcccccgcccaguccgacguggcccuucugcgcuucgugaauccugauacgagccggguucucuuugaauguaaacugcacaagucuggauaugucaccguggcucacacaggccaguacgaccuugugcugcccagcaacggguauuucagauuugauuccugggucaaccaguucuacacccucgcuccgaugggcaauggaacaggccgccggagauga

SEQ ID NO: 30413 - RNA, 1614 nt, Artificial Sequence
  derived and/or modified sequence opt5 from VP1__Norovirus_and/or_Norovirus-like__KX514310
augaagauggccagcaacgacaccaaucccuccgauggcucugcugccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcuccaaaccuuucagcguucccgugcugacggucgaggaaaugaccaacucuagauuuccugccacacuugauaagcuguucaccgggcccuccagcacauucgugguucagccgcagaauggacgguguaugaucgacggcgugcuccuggggaccacgcaacugucuccugucaacauuugcacauuucgcggagaugugacccaucccagagacuccaaaaucuacacaaugaaucucgccagcccuaacuggaauaacuaugaccccaccgaggagaucccugcuccccugggcaccccggauuucgucggcaagauucacgggaugcuuacacagacgacccaggaaaauggauccacacgggcgcaucgcgccaccguguacguuggcggggcuaacuuuacaccuaagcugggaaaagugcaguucgagaccgacacgggcgaugaccucgccaucagacaaaauacaaaguuuacccccgucggggugauucagucuagcgaucaccaccgggacgaaccccagcaauggcgccugccuaacuacuccggagccaauaccuucaacguucaucuugcuccggccguggcgcccacauuuccuggcgagcagcuccuguucuuuagaagcaccauccccggcugugggggacacccuaauaugaaccuggauugccugcucccccaggaauggguccagcauuucuaucaagaggcugccccugcccagucugacguggcucugcuucgguuugugaaccccgauacauccagaguucuguucgaguguaaacuccacaagagcggcuacgucacgguggcccacaccgggcaguaugaccuggugcuuccgucuaauggauacuuucgcuucgauagcugggucaaccaguucuauacacuggcuccuaugggcaaugggaccggccggagacgcuga

SEQ ID NO: 30414 - RNA, 1614 nt, Artificial Sequence
  derived and/or modified sequence opt5 from VP1__Norovirus_and/or_Norovirus-like__KX514185
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccgucaaucuugaacggcuguucaccggaccguccagcgccaacgugguucagccucagaauggccgcuguacaauugaugggggacuccugggcaccacgcaacugucuuccgugaacaucugcacauucagaggcgacgucacccauaucgggacaacccggcacuggaccaugaaucucgccagccccaacuggaauaacuacgauccuacagaggagacgcccgcuccucugggaacccccgacuuugugggcaagauucaugggaugcuuacacagaccacacagggauccggcucuacccgcgcgcacagagccacggucuauguggggagcgcugaguucacaccgaaacugggaaagguucgguuugaaaccgacaccgaagaugaccucgugauccgccagaauacaaaguucaccccugucggcgugauucaauccagcgagcaccauagagaugaaccccagcaguggcggcugcccaacuacucuggcgccaauacauuuaacguucaccuugccccugcuguggccccgaauuuccccggggagcaacugcucuuuuucagauccacgcugccuggauguggcgggcaucccaacauggaccuggauugccuccugccucaggaguggguccagcacuuuuaccaggaagcggcucccgcccaaagcgacguggcccuucugcgcuucgugaauccugauaccucucggguucucuuugaguguaaacugcacaagagcggauaugucacaguggcucauaccggccaguacgaccuugugcugcccuccaacggguauuucagauuugauucuugggucaaccaguucuacacacucgccccgaugggcaauggaaccggccgccggagauga

SEQ ID NO: 30415 - RNA, 1614 nt, Artificial Sequence
  derived and/or modified sequence opt5 from VP1__Norovirus_and/or_Norovirus-like__KX514181
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacaguucagcguucccauccugaccgugggggagaugacaaacucuagauuuccugucaaucuugaacggcuguucaccggacccuccagcgccaacgugguucagccgcaaaauggccgcuguacaauugauggggagcuccugggaaccacgcagcugucuuccgugaacaucugcacauucagaggcgacgucacccauaucggcacaacccggcacuggaccaugaaucucgccagcccuaacuggaauaacuacgaucccacagaggaaacgccugcuccccuggggaccccugacuuugugggaaagauucauggcaugcuuacacagaccacacagggguccggaucuacccgcgcgcacagagccacggucuaugugggcagcgcugaguucacacccaaacuggggaagguucgguuugaaaccgacaccgaggaugaccucgugauccgccaaaauacaaaguucaccccggucggagugauucaguccagcgaacaccauagagaugagccucagcaauggcggcugcccaacuacucuggcgccaauacauuuaacguucaccuugcccccgcuguggccccuaauuucccgggcgagcagcugcucuuuuucagauccacgcugcccggguguggaggccauccuaacauggaccuggauugccuccugccccaggaauggguccagcacuuuuaccaagaggcggcuccugcccagagcgacguggcccuucugcgcuucgugaaucccgauaccucucggguucucuuugaauguaaacugcacaagagcggguaugucacaguggcucauaccggacaguacgaccuugugcugccuuccaacggcuauuucagauuugauucuugggucaaccaguucuacacacucgcccccauggggaauggcaccggacgccggagauga

SEQ ID NO: 30416 - RNA, 1614 nt, Artificial Sequence
  derived and/or modified sequence opt5 from VP1__Norovirus_and/or_Norovirus-like__KF712493
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucauugacccuuggaucagaaauaacuucgugcaggcccccggcggggaauuuacaguuuccccucggaaugcgcccggagaggugcuguggucugccccucuuggcccggaucugaaccccuaccucagccaccuggcucgcauguauaauggguacgccggaggcuucgaaguccaggugauucuugcuggcaacgccuuugcggccgggaaaaucauuuucgcugccguuccucccaauuuuccuacggagggacugucccccucucaggugaccauguucccgcaucucaucgucgacgugagacaacuggagccugugaugaucccccugccugauauucggaacaauuuuuaucacuacaaccagagcaaugaccccacaaucaagcucauugcuaugcuguauacaccccuucgcgccaacaacgucggcgaugacguuuucaccguguccugcagagugcugacccggccuagcccggauuuugacuucaucuuucucgugcccccuacagucgaaucuaaaaccaaucccuucuccguuccuauucugacgaucgaggaaaugaccaacagccgcuuucccauuccgcuugagaagcuguucacagggccuucuuccgcccucgugguccagccccagaauggaagauguaccacagauggcgugcugcuggggaccacgcaacucagcccuguuaacaucugcacauuccggggagacgugacccauacaaccaaaacccacacauaccagaugaaucuggcugcgcagaacuggaacucuuaugaucccacggaggaaaucccugcuccccuuggcaccccggacuuugucggcaagauucagggggugcugacacaaaccacaaagggaaauggcuccacccgcgcccauaaagccacggucuacacagggggaguggaguucaccccuaagcucggcagaauccagcuguuuaccgacacagauaaugaccuugaagccaaccagaauaccaaauucacacccguuggggugauucaagauggagacacgcaccagaacgagccccagcaguggguccugccuagcuacuccggccggaauaaccacaaugugcaucucgcuccggccguugcgcccaccuuuccuggcgaacaacugcuguucuuucgcucuacaaugcccggguguagcggauauccuaacaugaaccucgauugccugcuuccccaggagugggugcaguacuucuaucaggaggcugccccugcccaauccgacgucgcucugcucagauuugugaaucccgauaccggccgggugcuguucgaauguaaacuucacaagagcggguacguuacagucgcccauaccggacaccacgaccuguuuaucccgccuaacggcuauuuccgcuuugauucuugggugucccccuucuacacgcucgcuccuauggggaauggcaccggaagacggagauga

SEQ ID NO: 30417 - RNA, 1614 nt, Artificial Sequence
  derived and/or modified sequence opt5 from VP1__Norovirus_and/or_Norovirus-like__FJ411169
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgccgauguuuucaccguguccagacgggugcugacacgccccagcccugacuuugauuucaucuuuucugucccgcccaccguggaauccagaacgaaaccuuucaccguucccauccucacaguggaggaaaugagcaacucucgguuuccuauuccccuggagaaacuuuacaccgggccguccagcgccuucgucgugcagccucagaauggacgcugcacaaccgacggcguucugcucgggacgacacaacugucugcugugaacaucuguaccuucagaggagaugucacacauaucgcgggcucccacgacuauaccaugaaucuggccagccagaacuggaauaacuacgaucccaccgaggaaauuccugcuccccucggcacaccugacuuuguggggaagauccagggaaugcugacgcagaccacacgggaggacggcuccacccgcgcccauaaggccacagucucuaccgggagcgugcacuucacgcccaaacuuggauccguucaauacacaaccgauaccaauaacgacuuucagacaggccagaauaccaaguucacaccggugggggucauucaagauggaaacaaucaccagaacgaaccucagcagugggugcugcccaauuauagcggcagaacgggccauaacguucaccucgcucccgccguggcgccuaccuuuccgggggagcaacugcuuuucuuucggucuacaaugcccggaugcuccggcuacccuaacaugaaucuggacugucuccugccccaggaauggguccagcauuucuaucaggaggcugccccugcccaaagcgauguggcucugcuccgcuuugugaaccccgacaccgggagaguucuguucgagugcaaacuucacaagucuggauacgucacaguggcccacaccggcccucaugaucuggugauucccccgaauggguauuuucgguucgacagcugggucaaccaguuuuacacgcucgcuccuaugggcaauggagccggcagacgccgguga

SEQ ID NO: 30418 - RNA, 1614 nt, Artificial Sequence
  derived and/or modified sequence opt5 from VP1__Norovirus_and/or_Norovirus-like__AF427121
augaagauggccagcaacgacgcuaaucccuccgauggcucuaccgccaaccuggugccugaggucaauaacgaaguuaugacacucgagccgguggugggggcggcuaucgccgcccccgucgcuggacagcaaaaugugauugacccuuggaucggcaacaauauuguucaggcccccgggggagaguucacggugagcccuagaaacgcucccggcgaaauccugugguccgccccucuugggccggaucugaaucccuaccucucucaccuggcgcggauguauaacggauacgccggcggcuuugaaguccaggugauucuugcugggaaugccuucaccgcuggaaaaaucaucuuugccgcgguuccucccaacuucccuacagagggccugagccccucccaggugaccgucuuuccgcauauuaucguggacgugcgccaacucgagccuguccugauuccccugccugauguuagaaauaacuuccaccauuauaaucagucuaacgacagcacaaucaagcucauugccaugcuguacacaccccuucgggcuaacaaugccggggaugacguguuuaccguguccugccgcguccugaccagacccagcccugauuucgacuuuaucuuccucgugccgcccacgauugaaucucggaccaaaccuuuuacaguucccauccugaccguggaggaaauguccaacagccgcuucccuaucccccuugagaagcuguauacaggaccgucuuccgcuuuugucgugcagccucagaauggcagauguaccacggaugggguucuccugggaacaacccaacugagcgccgugaacauuugcacauuccggggcgacgucacccacaucgccggcucucaugauuacaccaugaaucucgcuucccagaacuggaauaacuaugaccccacagaggaaauuccugcgccccuggggacgccugacuucgugggaaaaauccagggcguccuuacccagacaacccgcgaggaugggagcacaagagcccacaaggcuaccguguccacgggaucuguucacuuuacacccaagcugggcagcgugcaauacaccaccgacacauccaaugauuuccagaccgggcagaacacaaaauuuacgccggucggagugauucaagacggcaauaaccaucagaaugaaccucagcaguggguucuccccaacuacagcggccggaccgggcacaaugugcaucuggcccccgccgucgcuccuacauucccgggagagcaacuucuguuuuuccgcucuaccaugcccggcuguuccggguauccuaacaugaaccucgauugccugcugccccaggaaugggugcagcacuuuuaccaggaggccgcgccugcucaaagcgacguggcccuccugagauucguuaauucugauacaggacggguccuuuuugaguguaagcugcacaaaagcggcuaugugaccguggcccauacggggccccacgaccucgucaucccucccaacggcuacuuccgcuuugauuccugggugaaucaguucuauacccuggcuccgaugggaaacggcgccgggagacggagauga

SEQ ID NO: 30419 - RNA, 1614 nt, Artificial Sequence
  derived and/or modified sequence opt5 from VP1__Norovirus_and/or_Norovirus-like__KF429787
augaagauggccagcaacgacgcuacccccuccgauggcucuagcgccaaucuggugccugaggcgaacaaugaagucauggcucucgagccgguugccggggccgcuaucgccgcucccguggccggacagcaaaacgugauugacccuuggaucagaaauaacuucguccaggcgcccggcggggaauuuacaguguccccucggaaugcccccggagagauucuguggucugcuagccuuggcccugaucugaacccguaccucucccaccugucucgcauguauaauggguacgccggcagcuucgaaguucaggugauccuugcuggaaacgccuuuacggcgggcaaaauuaucuucgccgcugugcccccuaauuuuagaaccgaggggcugucccccagccagaucacaauguucccucauauuaucaccgacguccggcaacucgagcccguucugauuccgcugccugauauccgcaacaauuuuuaucacuacaaccagucuaaugaccccacaauuaagcucaucgccaugcuguauaccccucuuagagcuaacaacgccggagaugacguguucacagucuccugccgggugcugacccgccccagccccgauuuugacuucauuuuucucgugccuccgacggucgaaucuagaaccaaacccuucuccguuccugugcugacaguggaggaaaugaccaauagccgguuucccaucccucuugagaagcuguucacaggccccucuuccgccuucgucgugcagccgcagaacgggcgcuguaccacggauggaguucuccugggcacaacccaacugagcccugugaauaucugcacauuuagaggggacgucacccggauuggaaacucccgcgaguacagaaugaaucucgcuucucugaacuggaauaacuaugaucccaccgaagagaucccugcgccccuuggcacaccugacuucgccggcaaaauucagggggugcugacgcagaccacacggcaugacggaagcacccgcggccacaaggcuacaguuuacaccggguccgccggauuuacgcccaagcucggcagcgugcaguucucuacagauaccgacaaugaucuggaagccaaccaaaauaccagauuuacaccggucggggugauccaggacggaaacgcucaucagggcgagccucaacaguggguccuucccaauuacgccggccgggaugggcacaacgugcaccuggcgcccgcuguugccccuaccuucccgggagaacagcuccuguuuuucagauccacaaugcccggcuguagcggguauccuaauaugaaccuggacugccuccugccccaggagugggugcaacauuuuuaccaggagucugccccugcucagagcgaugucgcccuucugcgcuucgugaaccccgacacgggacggguucucuuugaauguaaacugcacaaguccggcuaugugaccgucgcucauacagggccucacgaucuugugauucccccgaauggcuacuucagauuugacucuugggugaaccaguucuauacccuggccccuaugggaaauggcgcggggcgccggagauga

SEQ ID NO: 30420 - RNA, 1614 nt, Artificial Sequence
  derived and/or modified sequence opt5 from VP1__Norovirus_and/or_Norovirus-like__AB933728
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuaucccucccaacuuuccuacggagggacugagccccucccagguuaccauguucccgcauauuguggucgacgugagacaacucgagccugugcugaucccccugccugauguccggaauaacuuuuaucacuacaaucagacaaaggaaucuaccauuaaacucguugccaugcuguauacaccccuucgcgcuaacaacgccggcgacgauguguucaccgugagcugcagaguccugacacggcccuccccugacuuugauuucaucuuucucgugccgcccagcguugagucucgcaccaagccuuucacggugcccauucugaccgucgaagagaugacaaauuccagauuuccuaucccccuugagcggcuguucaccgggccgagcucugccuucgugguucagccucagaacggacgcuguacaaccgacggcgugcuccuggggacgacacaacugucccccgucaauauuugcaccuuuagaggagaugugacacgggucagcaccacccauguguacgaaaugaaccucgcuucucagaauuggaacaauuaugacccuacagaggaaguucccgcgccucugggcacgcccgauuucgugggcaaaauccaggggguccuuacccagacaacccgcacagacggauccaccagagcccacaaggcuacggugagcacaggcgccgccgacuuuaccccgaagcugggguccauccgguucgagaccacaaccaaccgcgaucucgaaacacaucaaaauacgaaauuuaccccuguuggagugauucaggacggcgauaaccaccagaaugagccccaacaguggagacugcccggguacgcuggacgggacgcccacaacguccaucuugcgccugcuguggccccgacauuccccggcgagcagcugcucuuuuucagaucuaccaugccuggcuguagcggguaccccaauaugaaccuggauugccugcucccucaggaaugggugcaacacuuuuaucaggaggccgcucccgcccaguccgacguugcucugcuucgcuucgucaauccugauacaggacgggugcuguuugaauguaagcuccauaaaagcggcuaccugaccguggcccacacggggcccuaugaccuugucaucccgccuaacggauacuucagauuugauucuugggugaaccaguucuauacccuggcgcccaugggcaaugggacaggccgccggagauga

SEQ ID NO: 30421 - RNA, 1614 nt, Artificial Sequence
  derived and/or modified sequence opt5 from VP1__Norovirus_and/or_Norovirus-like__KX514346
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaaccccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaauagcagauuucccgucaaccuugaacggcuguucaccggaccgucuuccgccaaugugguucagccucagaacggccgcuguacaauugauggggagcuccugggaaccacgcaacugagcucugugaauaucugcacauucagaggcgacgucacccagaucggcuccacaaagcauuggaccaugaaccucgccagccccaauuggaacaauuacgauccuaccgaggaaacacccgcuccucuggggacgcccgacuuugugggaaaaauucacggcaugcuuacccagacaacccaggagaacggguccacacgggcgcaucgcgccaccgucuaugugggaggcucuaauuucacgccgaagcuggggaagguuccuuuugaaacagacaccggagaugaccucgcuaucagacaaaacaccaaauucacacccgugggcgucauucagagcuccggccaccaccgggaugagccccagcaauggcgccugccuaauuacagcggggccaacaccuuuaaugugcaucuugccccggcuguugcccccaacuucccuggagaacagcugcucuuuuucagaucuacacugcccggcugugggggacacccuaacauggaccuggauugccuccugccccaggagugggugcagcauuuuuaccaagaggcggcuccugcccaguccgacgucgcccuucugcgguucgugaaucccgauacgagcagagugcucuuugaauguaagcugcacaaaucuggcuauguuaccgucgcucacacagggcaguacgaccuugugcugccgagcaacggcuauuuccgcuuugauuccugggugaaucaguucuacacccucgccccuaugggaaacggcacagggcggagacgcuga

SEQ ID NO: 30422 - RNA, 1614 nt, Artificial Sequence
  derived and/or modified sequence opt5 from VP1__Norovirus_and/or_Norovirus-like__KX514249
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugaccucauuuuccuggugcccccuaccgucgaaucccgcacgaaacccuuuagcguuccuauccuuaccgugggggagaugacaaacucuagauuccccauuaaucuggaaggacucuuuaccggcccguccagcgccaacgucgugcagccucagaaugggcgguguacaaucgauggagagcugcugggcaccacgcaacucucuuccguuaacaucugcacauuccgcggcgacgugacccauauugggagcacacaccauuggaccaugaaucuggccucccccaacuggaauaacuacgauccuaccgaggaaacacccgcuccucuuggaacgcccgacuucgucggcaagauccacgggaugcugacccagacaacccagggaucuggcagcacaagagcgcaccgggccaccguguaugucgggggagcugaguuuacgccgaaacucggcaaggugcaguucaagacagaaaccaaucaugaccuguccauucgccaaaacaccaaauuuacaccuguuggcgugauccaggagagcgaucaccauagagacgaaccccagcaauggcggcuucccaauuacucuggggccaacaccuucaauguccaccuggccccugcuguggccccgaacuuucccggagagcagcuccuguucuuucgcuccacacugccuggcugugggggacaccccaauauggaucucgacugccugcuuccucaggaguggguucagcauuucuaccaagaagcggcucccgcccagagcgauguggcccugcucagauuugucaacccugacacgucucgggugcuguucgaguguaaacuucacaagagcggcuaugugaccguugcucauacagggcaguacgaucugguccuccccuccaacggcuauuuuagauucgacucuugggugaaucaguuuuacacccuggccccgaugggaaacggcacagggcgccggagauga

SEQ ID NO: 30423 - RNA, 1614 nt, Artificial Sequence
  derived and/or modified sequence opt5 from VP1__Norovirus_and/or_Norovirus-like__KF429760
augaagauggccagcaacgacgcuacccccuccgauggcucuagcgccaaucuggugccugaggucaacaaugaaguuauggcgcucgagccgguggcuggggccgccaucgcugcccccguggcuggacagcaaaacgucauugacccuuggaucagaaauaacuucgugcaggcccccggcggggaauuuacaguuuccccucggaaugcgcccggagagauucuguggucugccagccuuggcccugaucugaacccguaccucucccaccugucucgcauguauaauggguacgcuggcagcuucgaagugcaggucauccuugccggaaacgcuuuuacggccggcaaaauuaucuucgcggccgugcccccuaauuuuagaaccgaggggcugucccccagccagaucacaauguucccucauauuaucaccgacguucggcaacucgagcccgugcugauuccgcugccugauauccgcaacaauuuuuaucacuacaaccagucuaaugaccccacaauuaagcucaucgcuaugcuguauaccccucuuagagccaacaacgcuggagaugacgucuucacaguguccugccgggugcugacccgccccagccccgauuuugacuucauuuuucucgucccuccgacgguugaaucuagaaccaaacccuucuccgugccugugcugacagucgaggaaaugaccaauagccgguuucccaucccucuugagaagcuguucacaggccccucuuccgccuucgugguucagccgcagaacgggcgcuguaccacggauggagugcuccugggcacaacccaacugagcccugucaauaucugcacauuuagaggggacgugacccggauuggaaacucccgcgaguacagaaugaaucucgccucucugaacuggaauaacuaugaucccaccgaagagaucccugcuccccuuggcacaccugacuucgcgggcaaaauucaggggguucugacgcagaccacacggcaugacggaagcacccgcggccacaaggccacaguguacaccggguccgcuggauuuacgcccaagcucggcagcguccaguucucuacagauaccgacaaugaucuggaagccaaccaaaauaccagauuuacaccggugggggucauccaggacggaaacgcccaucagggcgagccucaacagugggugcuucccaauuacgcuggccgggaugggcacaacguucaccuggcccccgcgguggcuccuaccuucccgggagaacagcuccuguuuuucagauccacaaugcccggcuguagcggguauccuaauaugaaccuggacugccuccugccccaggaguggguccaacauuuuuaccaggagucugccccugcccagagcgauguggcccuucugcgcuucguuaaccccgacacgggacgggugcucuuugaauguaaacugcacaaguccggcuaugucaccguggcucauacagggccucacgaucuugugauucccccgaauggcuacuucagauuugacucuuggguuaaccaguucuauacccuggcuccuaugggaaauggcgccgggcgccggagauga

SEQ ID NO: 30424 - RNA, 1614 nt, Artificial Sequence
  derived and/or modified sequence opt5 from VP1__Norovirus_and/or_Norovirus-like__AB303929
augaagauggccagcaacgacgcuaaucccuccgauggcucugccgcgaaccuggugccugaggucaauaacgaaguuauggcucucgagccgguggugggggccgccaucgcugcccccgucgcuggacagcaaaauauuaucgacccuuggauuagaaacaauuucgugcaggcccccggcggggaauuuaccguuagcccucggaacgcgcccggagagauccugugguccgccccucuuggcccggaucugaaucccuaccucucucaccugagccgcauguauaacggguacgcuggaggcuucgaagugcaggucauucuugccggcaaugcuuuuacagccgggaaagugaucuucgcggccguuccucccaacuuuccuacggagggacugucccccucucaggugaccauguucccgcauaucauugucgacgugagacaacucgagccugugcugaucccccugccugauguccggaauaacuuuuaucacuacaaucaggcucaugacagcacacucaagcugauugccaugcuuuauacaccccugcgcgcuaacaacgccggcgaugacguuuucaccguguccugcagagugcucacccggcccagcccugauuuugacuucaucuuucuggucccgcccacaguggaaucucgcaccaaaccuuucacgguucccgugcuuaccgucgaggaaaugacaaauuccagauuuccuauuccccuggagaagcucuacaccgggccgagcucugccaucgugguucagccucagaacggacgguguacaaccgauggcgugcugcuggggacgacacaacucuccgcugucaauauuugcaccuuccgcggagacgugacacacaucgcgggcagcagaaacuauaccaugaaucuggccucucagaacuggaauaacuacgaucccaccgaggaaaucccugcuccccuuggcacaccugacuucgucgggaaaauucagggacugcucacgcagaccacacgggccgacggcuccacccgcgcccauaaggcuacagugagcaccggguccguucacuuuacgcccaagcugggaucugugcaauucagcacagauaccgacaaugauuuucagccgggccagaacaccaaauucacaccugucggggugauccaagacggagauagacaccagaaugagccccagcaguggguucuucccgacuuuuccggccggaccggccauaacgugcaccuggccccugcggucgcuccgacauuccccggggaacaacuccuguuuuuccgcagcacgaugccuggaagaucuggcuaccccaauaugaaccuggauugucuccugccucaggagugggugcuucauuuuuaucaggaauccgcccccgcccagagcgacguggcucugcuccgguucguuaauccugauaccaacagaguccuguuugagugcaagcuccacaaaucuggguacauuacaguggcccacaccggacaucacgaccugauccuucccccgaacggcuauuuccgcuuugauagcugggugaaucaauucuacacacuggcuccuauggggaacggcgccggacggagacgcuga

SEQ ID NO: 30425 - RNA, 1614 nt, Artificial Sequence
  derived and/or modified sequence opt5 from VP1__Norovirus_and/or_Norovirus-like__KX514363
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccauuaaucuugaacggcuguucacaggaccguccagcgcuaacgucgugcagccucagaauggccgcuguaccaucgauggggagcuccugggaacgacacaacugucuuccguuaacaucugcaccuucagaggcgacgugacacagauuggcagcacccagcauuggaccaugaaucucgccucccccaacuggaauaacuacgauccuacagaggaaacgcccgccccucuggggacccccgacuuugucggaaagauccacggcaugcuuacacagaccacacaagagaaugggucuacccgggcucaucgcgcgacgguguaugucggaggcgccaacuucacaccgaaacuggggaaggugagauuugaaaccgacaccggagaugaccucgcuauucggcagaauacaaaguucaccccuguuggcgugauccagagcuccgaucaccaccgcgacgagccccaacaguggagacugcccaacuacagcggcgccaauacauuuaacguccaucuugccccugcuguggccccgaauuuccccggggaacagcugcucuuuuuccggucuacgcugccuggauguggcgggcaccccaacauggaucuggacugccuccugccucaggaguggguucaacauuuuuaccaggaggcggcucccgcccaguccgauguggcccuucugagauucgucaacccugacaccagccgcgugcucuuugaauguaaacugcacaagucuggauaugugacaguugcucacaccggccaguacgaucuuguccugcccagcaauggguauuuccgguuugacuccugggugaaccaauucuacacacucgccccgaugggcaauggaaccggcagacgccgguga

SEQ ID NO: 30426 - RNA, 1614 nt, Artificial Sequence
  derived and/or modified sequence opt5 from VP1__Norovirus_and/or_Norovirus-like__KX514357
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcacgaaacccuucagcguuccuauccugaccgugggggagaugacaaacucuagauuucccauuaaucuugaacggcuguucaccggaccguccagcgccaacgucgugcagccucagaauggccgcuguacaaucgauggggagcuccugggaaccacgcaacugucuuccguuaacaucugcacauucagaggcgacgugacccauauuggcagcacacaccauuggaccaugaaucucgccucccccaacuggaauaacuacgauccuaccgaggaaacacccgcuccucuggggacgcccgacuuugucggaaagauccacggcaugcuuacccagacaacccaggggucuggaagcacacgggcgcaccgcgccaccguguaugucggcuccgcugacuucacgccgaaacuggggaaggugcaguuugagacagaaaccgaucaugaccucgccauuagacaaaauaccaaguucacaccuguuggagugauccaggagagcgauaaccaccgggacgaaccccagcaauggcgccugcccaauuacucuggcgccaacaccuuuaauguccaucuugcuccugccguggcgccgaacuuccccggcgagcagcugcucuuuuucagauccacaauuccuggguguggaggccaccccaauaugaaccuggauugccugcucccucaggaguggguucagcacuuuuaccaagaagcugcccccgcccagagcgacguggcucugcuucgguucgucaacccugauacgucuagagugcuguuugaguguaaacuccauaagagcggguaugugaccguugcccacacaggacagcaugaccuggucauucccccgaauggcuacuuccgcuuugauuccugggugaaccaguucuauacccuugcuccuauggggaauggcacaggacggaaaagauga

SEQ ID NO: 30427 - RNA, 1614 nt, Artificial Sequence
  derived and/or modified sequence opt5 from VP1__Norovirus_and/or_Norovirus-like__KX514240
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccagagacuccccuaucuacaccaugaaucucgcuagccccaacuggaauaacuaugacccuacagaggagauccccgcgccgcugggcaccccugauuucgucggcaaaauucacgggaugcuuacccagacaacgcagggauccggcucuacccgggcccaucgcgcuacaguguacguugggagcgccgaauuuacccccaagcugggaaaggugcaguuccaaacagagaccgaagacgaucucgucaucagacagaauacgaaauuuacacccgugggcguuauucaggaguccgaccaccaccgggaugaaccucaacagugggugcugccgagcuacucugggcgcgacacccccaacguccaucuugccccugcuguggcccccaccuucccuggagagcagcugcucuuuuucagauccacaauccccggcuguggcgggcacccuaauaugaaccuggauugccugcucccccaggagugggugcaacauuuuuaucaggaagcggcuccggcccagagcgacguugcccugcuucgguucgucaauccugauaccucuagagugcuguuugaguguaagcuccacaaaagcggauacgugacagucgcucacacgggccagcaugaccuggugauucccccuaacggguauuuccgcuuugauuccuggguuaaucaauucuacacccuugcccccaugggaaacggcacagggcggaagagauga

SEQ ID NO: 30428 - RNA, 1614 nt, Artificial Sequence
  derived and/or modified sequence opt5 from VP1__Norovirus_and/or_Norovirus-like__AF414417
augaagauggccagcaacgacgcuaaucccuccgauggcucugccgcgaaccuggugccugaggucaauaacgaaguuauggcucucgagccggugguggacgccgccaucgcugcccccgucgcugggcagcaaaaugugauugauccuuggaucagaaacaauuucguucaggcccccggaggcgaauuuaccgugagcccucggaacgcgcccggggagauucugugguccgccccucuuggaccggaccccaauccuuaccugucucaccucagccgcauguauaacggcuacgcugggggauucgaaguccaggugauccuggccggcaaugcuuuuacagccggcaaaguuauuuucgcggccgugcccccuaacuuucccacggaggggcuuuccccgucucaggucaccauguucccucauaucaucguggaugugagacaacuggagcccaugcucauuccucugcccgacguccggaauaacuuuuaucacuacaaucaggcuaacgauagcacacugaagcucaucgccacccuguauacaccccuucgcgcuaacaaugccggagacgauguuuucaccguguccugcagagugcugacacggccuagcccggacuuugauuucauuuuucucgugcccccuaccgucgaaucucgcacgaaacccuucaccguuccugugcugacagucgaggaaauguccaacagcagauuucccaucccgcuugagaagcuguacaccggcccuucuuccgccuucgugguucagccccagaaugggcgguguacaaccgacggagugcuccugggcacgacacaacugagcgcugucaacauuugcaauuuccgcggggauguggcgcauaucgccggaucucacgacuauaccaugaaccucgcuucccagaauuggagcaacuacgacccuacagaggaaauucccgccccucugggcacccccgauuuugucggcaaaauccaggggcuucugacccagacaacgagagccgacggacucacccgggcucauaaggccacaguguccaccggcucuguucacuucacaccgaagcuggggagcgugcaauuuaccacggauacaaauaacgacuuccaggcgggacagaauaccaaauuuaccccugucggcgugauccaagauggggaccaccaucagaacgagccccagcaguggcuucugcccaauuacuccggacgcacaggccacaacguucaucucgcuccugccguggccccgaccuuccccggcgaacaacugcuguuuuucagaagcacaaugccuggguguucuggauaucccaauaugaaccucgauugccugcuuccucaggaguggguccugcacuuuuaccaggaagcugcccccgcucaguccgacguggcccuccugcgguucgugaacccugauacgggccgcguucuuuuugaguguaagcugcacaaaagcggguauauuaccgucgcgcauacaggacccuacgaccucgugcugccgccuaauggcuauuucagauuugauucuugggugaaccaauucuacacccuggcccccauggggaauggcacaggacggagacgcuga

SEQ ID NO: 30429 - RNA, 1614 nt, Artificial Sequence
  derived and/or modified sequence opt5 from VP1__Norovirus_and/or_Norovirus-like__KX514303
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccgucaaucuugaacggcuguucacaggaccguccagcgcuaacgugguucagccucagaauggccgcuguaccauugauggggagcuccugggaacgacacaacugucuuccgugaacaucugcaccuucagaggcgacgucacacagaucggcagcacccggcauuggaccaugaaucucgccucccccaacuggaauaacuacgauccuacagaggaaacgcccgccccucuggggacccccgacuuugugggaaagauucacggcaugcuuacacagaccacacaggggucuggaagcacccgcgcucauagagcgacggucuaugugggcuccgccgaguucacaccgaaacuggggaagguucgguuugaaaccgacaccgaggaugaccucgugauccgccaaaauacaaaguucaccccugucggagugauucagagcucugaucaccacagagacgaaccccagcaauggcggcugcccaacuacuccggcgcuaauacauuuaacguucaucuugccccugccguggcuccgaauuuccccggcgagcagcugcucuuuuucagaagcacgcugccuggguguggaggccaccccaacauggaucuggacugccuccugccucaggaguggguccagcauuuuuaccaagaagccgcgcccgcucagucugauguggcccuucugcgcuucgugaauccugacaccagccggguucucuuugaguguaaacugcacaaguccggguaugucacaguggcccacaccggacaguacgaucuugugcugcccucuaacggcuauuucagauuugacagcugggucaaccaguucuacacacucgcuccgauggggaauggcaccggacgccggagauga

SEQ ID NO: 30430 - RNA, 1614 nt, Artificial Sequence
  derived and/or modified sequence opt5 from VP1__Norovirus_and/or_Norovirus-like__KX514273
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaacgcuggcgaugacguuuucaccgugagcugcagagugcugacccggcccucuccugauuuugacuucauuuuucucgucccgcccacgguggaaucccgcagcaaaccuuucucuguucccgugcugaccgucgaggaaaugacaaacuccagauuuccugccacccuugauaagcuguucacagggcccagcucuaccuucgugguucagccgcagaauggacgguguaugaucgacggcgugcuccuggggacgacacaacuguccccugucaacauuugcaccuuucgcggagaugugacacaucccagagacagcccuaucuacaccaugaaucucgccucccccaacuggaauaacuaugacccuaccgaggagauccccgcuccgcugggcacaccugauuucacgggcaaaauucaggggaugcuuacccagacaaccaagggagaaggcucuacacgggggcaccgcgcgaccgucuacgugggaagcgccgaguuuacgcccaagcugggcaaaguuagauucgaaacagacaccgaggaugaccucgugauccggcagaauaccaaguuuacacccgucggggugauucaauccagcgaucaucaccgcgacgaaccucagcaguggagacugccgaacuacucuggagcuaauaccuucaacguucaccuugcccccgccguggcuccuaauuuucccggcgagcaacuccuguucuuucgguccacacugccuggcugugggggacaucccaacauggaucuggacugccuccugccucaggaguggguccagcacuucuaucaggaagccgcgcccgcucaaagcgauguggcccuucugagauuugugaauccggacacgucucgcguucucuucgaguguaaacugcauaagagcggcuacgucaccguggcccacacagggcaguaugaucuugugcugccuuccaacggauacuuucgguucgacucuugggucaaucaguucuauacccucgcucccaugggcaacgggacaggcagacgccgguga

SEQ ID NO: 30431 - RNA, 1614 nt, Artificial Sequence
  derived and/or modified sequence opt5 from VP1__Norovirus_and/or_Norovirus-like__KX514323
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaccuucgugguucagccgcagaauggacgguguaugaucgacggcgugcuccuggggacaacccaacugucuccugucaacauuugcacguuucgcggagaugugacacaucccggcaauuccaaaaucuacaccaugaaccucgcuagcccuaauuggaacaauuaugaccccacagaggagaucccugcgccccugggcaccccggacuucgucgggaagauucacggaaugcuuacccagacaacgcaggaaaacggcuccaccagagcccaucgggcuacaguguacguugggggagccaauuuuaccccuaagcugggcaaagugcaguucgagacagauaccggggacgaucucgccauccgccaaaacacgaaguuuacacccgucggagugauucagucuagcgaccaccacagagaugaaccccagcaauggcggcugccuaauuacuccggcgcuaacaccuucaauguucaucuugccccggcgguggcucccaacuuuccuggcgagcagcuccuguucuuucgcagcaccauccccggguguggaggccacccuaacaugaaucuggacugccugcucccccaggaauggguccagcauuucuaucaagaggccgccccugcucagucugauguggcccugcuuagauuugugaaccccgacacaucccggguucuguucgaguguaaacuccacaagagcggguacgucaccguggcucacacaggacagcaugaucuggugauuccgccuaauggcuauuuuagauucgacucuugggucaaccaguucuacacgcuugcccccauggggaauggcaccggacgcaaacgguga

SEQ ID NO: 30432 - RNA, 1614 nt, Artificial Sequence
  derived and/or modified sequence opt5 from VP1__Norovirus_and/or_Norovirus-like__KX514364
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccauuaaucuugaacggcuguucacaggaccguccagcgcuaacgucgugcagccucagaauggccgcuguaccaucgauggggagcuccugggaacgacacaacugucuuccguuaacaucugcaccuucagaggcgacgugacacagauuggcagcaccaagcauuggaccaugaaucucgccucccccaacuggaauaacuacgauccuacagaggaaacgcccgccccucuggggacccccgacuuugucggaaaaauccacggcaugcuuacacagaccacacaggagaaugggucuacccgggcucaucgcgcgacgguguaugucggaggcgccaacuucacaccgaagcuggggaaggugcaauuugaaaccgacaccggagaugaccucgcuauuagacagaauacaaaauucaccccuguuggcgugauccagagcuccgaucaccaccgggacgagccccaacaguggcgccugcccaacuacagcggcgccaauacauuuaacguccaucuugccccugcuguggccccgaauuuccccggggaacagcugcucuuuuucagaucuacgcugccuggauguggcgggcaccccaacauggaucuggacugccuccugccucaggaguggguucaacauuuuuaccaggaggcggcucccgcccaguccgauguggccccucuucgguucgucaaccccgacaccagcagagugcuguuugaauguaagcuccacaaaucuggauaugugacaguugcucacaccggccaguacgaucugguccuuccgagcaauggguauuuccgcuuugacuccugggugaaccaauucuacacacuggccccuaugggcaauggaaccggccggagacgcuga

SEQ ID NO: 30433 - RNA, 1614 nt, Artificial Sequence
  derived and/or modified sequence opt5 from VP1__Norovirus_and/or_Norovirus-like__KX514338
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcuccaaaccuuucagcguucccgugcugaccgucgaggaaaugacgaacucuagauuuccugccacccuugauaagcuguucacagggcccuccagcaauuucgugguucagccgcagaacggacgguguaugaucgacggcgugcuccuggggaccacacaacugucuccugucaauauuugcaccuuucgcggagaugugacgcagaucggcuccacaaaacauuggaccaugaaccucgcuagccccaauuggaacaauuacgacccuacagaggagacccccgcgccucugggcacccccgacuucgucgggaagauccacggaaugcuuacacagacgacccaggaaaacggcuccacaagagcccaucgggcuaccguguauguugggggagccaauuuuacaccgaagcugggcaaagugcaauucgagaccgauacggucgacgaucucgaaauucgccagaacacaaaguuuaccccuguggggguuauccagucuagcgaccaccacagagaugagccccaacaguggcggcugcccaauuacuccggagccaacaccuucaaugugcaucuugcuccugccgucgcgccgaacuuucccggcgaacagcuucucuucuuucgcagcacacugccuggcugugggggacaccccaacauggaccuggauugccuccugccucaggagugggugcaacauuucuaccaggaggcugcccccgcccagucugacguggcucugcugagauuuguuaauccugauaccucccggguccucuucgaauguaaacugcacaagagcggcuaugugacaguggcccacacggggcaguacgaccuuguccugcccucuaacggauauuuuagauucgauagcugggugaaucaauucuacacccucgcuccgaugggcaacgggacaggccgccggagauga

SEQ ID NO: 30434 - RNA, 1614 nt, Artificial Sequence
  derived and/or modified sequence opt5 from VP1__Norovirus_and/or_Norovirus-like__KX514316
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcagcaaacccuucucuguuccugugcugaccgucgaggaaaugacaaacuccagauuucccgcuacccuugauaagcuguucacagggccgagcucuaccuucgugguucagccucagaauggacgguguaugaucgacggcgugcuccuggggacgacacaacugucccccgucaacauuugcaccuuucgcggagaugugacacauccuagagacagcaaaaucuacaccaugaaucucgccucccccaacuggaauaacuaugacccuaccgaggagauccccgccccgcugggcacaccugauuucgucggcaagauucaggggaugcuuacgcagaccacaaagggagaaggcucuacccgggggcaccgcgcuacaguguacguuggaagcgcgaauuacgcccccaaacugggcagagugcaguuugagaccgacacgacagaugaccucgaugcucaucaaaacaccaaguucacccccgucggggugauccaguccagcgaccaccaccgggaugaaccucagcaauggcgccugccgaauuauucuggagccaacacauuuaauguucaucuugcccccgcuguggccccuaacuuccccggcgagcagcugcucuuuuucagauccacccugccuggcugugggggacaccccaauauggaccuggauugccuccugccucaggaauggguccagcauuuuuaccaagaggcggcucccgcccagagcgacguggcccuucugcgguucgugaacccggauacaucuagaguucucuuugaguguaaacugcacaagagcggcuaugucacgguggcucacaccgggcaguacgaccuugugcugccuuccaauggauauuuccgcuuugacucuugggucaaccaguucuacacacucgcccccaugggcaacgggaccggccggaaaagauga

SEQ ID NO: 30435 - RNA, 1614 nt, Artificial Sequence
  derived and/or modified sequence opt5 from VP1__Norovirus_and/or_Norovirus-like__KX514356
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacugcuaucacuacaaucagagcaacgacuccaccauuaagcucaucgccaugcuguauacaccccuucgcgcuaauaaccccggcgaugacguuuuuaccgugagcuguagagugcugacacggccuucuccggauuucgacuuuauuuuccucgugcccccuaccgucgaaucccgcacgaaacccuuuagcguuccuauccugaccgugggggagaugacaaacucuagauuccccauuaaucuugaacggcuguuuaccggaccguccagcgccaacgucgugcagccucagaauggccgcugcacaaucgauggggagcuccugggaaccacgcaacugucuuccguuaacaucuguacauucagaggcgacgugacccauauuggcagcacacaccauuggaucaugaaucucgccucccccaacuggaauaacuacgauccuaccgaggaaacccccgcuccucuggggacacccgacuucgucggaaagauucacggcaugcuuacgcagaccacacaggggucuggaagcacccgggcgcaccgcgccacaguguaugucggcuccgcugacuuuaccccgaaacuggggaaggugcaguucgagacggaaacagaucaugaccucgccaucagacaaaauaccaaguuuaccccuguuggagugauucaggagagcgaucaccaucgggacgaaccccagcaauggcgccugcccaacuacucuggcgccaauacauucaacguccaccuugcuccugccguggcgccgaccuuucccggcgagcagcuccuguucuuuagauccacaaucccugggugcggaggccaccccaauaugaaccuggauugucugcucccucaggaguggguucagcauuucuaccaagaagcugcccccgcccagagcgacguggcucugcuucgguuugucaauccugauacgucuagagugcuguucgagugcaaacuccacaagagcggguaugugaccguugcccauacaggacagcacgaccuggucauucccccgaacggcuacuuucgcuucgauuccugggugaaccaguuuuauacccuugcuccuauggggaauggcacaggacggaaaagauga

SEQ ID NO: 30436 - RNA, 1614 nt, Artificial Sequence
  derived and/or modified sequence opt5 from VP1__Norovirus_and/or_Norovirus-like__KX514349
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaucccggcgaugacguuuucaccguguccugcagagugcugacccggccuagcccggauuuugacuucauuuuucucgugcccccuacagucgaaucucgcuccaaacccuucagcguuccugugcugaccgucgaggaaaugacgaacucuagauuucccgccacccuugauaagcuguucacagggccguccagcaccuucgugguucagccucagaauggacgguguaugaucgacggcgugcuccuggggacaacccaacugucucccgucaacauuugcacguuucgcggagaugugacacaguccggcaauaccaaaaucuacacaaugaaccucgccagcccuaauuggaacaauuaugaccccaccgaggagaucccugcuccccugggcaccccggacuucgucgggaagauucagggaaugcuuacacagacgaccaagggcgaaggguccacaagaggacaucgggcgaccguguacguuggcggggccgaguuuacaccuaaacugggaaaggugcgcuucgaaaccgauacggaggacgaucucgucaucagacaaaacacaaaauuuacccccgugggcguuauucagaccucugaaaaucaccgggacgagccccagcaauggcgccugccuaacuacagcggcagagauacaccgaaugugcaucuugcucccgccgucgccccuaccuuccccggggagcagcugcucuuuuuccgguccacaaucccuggauguggcgggcaccccaacaugaaucuggacugccugcucccucaggaaugggugcagcacuuuuaucaagaggcugcccccgcgcagagcgauguggcucugcuuagauucguuaacccggacacgucucgcguccuguuugaauguaagcuccauaaauccggauacgugaccguggcccacacaggccagcaugaucuggucauuccucccaacggguauuuccgguuugacagcugggugaaucaguucuacacccuugccccuaugggcaacggaacaggcagaaagcgcuga

SEQ ID NO: 30437 - RNA, 1614 nt, Artificial Sequence
  derived and/or modified sequence opt5 from VP1__Norovirus_and/or_Norovirus-like__KX514217
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaacgccggcgaugacguuuucaccguguccugcagagugcugacacggcccagcccugauuuugacuucauuuuucucgucccgcccaccguggaaucucgcuccaaaccuuucagcguucccgugcugacggucgaggaaaugaccaauucuagauuuccugccacacuugauaagcuguucaccgggcccuccagcacauucgugguucagccgcagaacggacgguguaugaucgacggcgugcuccuggggaccacgcaacugucuccugucaauauuugcacauuucgcggagaugugacccaucccagagacuccccuaucuacacaaugaaccucgcuagccccaauuggaacaauuaugacccuaccgaggagauccccgcgccgcugggcaccccugauuucgucggcaaaauucaggggaugcuuacacagacgacccagggauccggcucuacacgggcccaccgcgcuaccguguacguugggagcgccgaauuuacacccaagcugggaaaggugcaauuccagaccgagacggaccaugaucucgucaucagacagaacacaaaauuuacccccgugggcguuauucaagaauccgaccaccaccgggaugagccucagcaguggcgccugccgaauuacagcggggccaacaccuucaaugugcaucuugcucccgccgucgcgccuaacuuucccggagaacagcuucucuucuuuagaucuacacugccuggcuguggcgggcaccccaauauggaccuggauugccuccugccucaagagugggugcagcauuucuaucaggaggcugcccccgcccaguccgacguggcucugcugcgguuuguuaacccggauaccagcagaguccucuucgaauguaagcugcacaaaucuggauacgugacaguggcccacacgggccaauaugaccuuguccugccuagcaauggguacuuucgcuucgauuccugggugaaccaguucuauacccucgcucccaugggaaacggcacagggcggagacgcuga

SEQ ID NO: 30438 - RNA, 1614 nt, Artificial Sequence
  derived and/or modified sequence opt5 from VP1__Norovirus_and/or_Norovirus-like__KX514324
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcagcaaacccuucucuguuccugugcugaccgucgaggaaaugacaaacuccagauuucccgcuacccuugauaagcuguucacagggccgagcucuaccuucgugguucagccucagaauggacgguguaugaucgacggcgugcuccuggggacgacacaacugucccccgucaacauuugcaccuuucgcggagaugugacacauagcggcaauuccaaaaucuacaccaugaaccucgccucuccuaauuggaacaauuaugaccccaccgaggagaucccugcuccccugggcacaccggacuucgucgggaagauucagggaaugcuuacgcagaccacaaagggcgaagggagcaccagaggacaccgggcuacaguguacguuggcggggcgaacuuuaccccuaaacugggaaaggugcaguucgagacggauacagucgacgaucucgaaauccgccaaaauaccaaauuuacccccgugggcguuauucaguccagcgaccaucacagagaugagccccagcaauggcggcugccuaacuacucuggcgccaauacauucaacgugcaccuugcuccggccgucgcccccaauuuuccuggggaacagcuccuguucuuucgcuccacccugcccggauguggcgggcauccuaacauggaccuggauugccuccugccccaggagugggugcagcacuucuaucaagaggcugccccugcgcagagcgacguggcccuucugagauuuguuaaucccgauacaucucggguccucuucgaauguaagcugcauaaaagcggauacgugacgguggcccacaccggccagcacgaccuugucaucccgccuaacggguauuuuagauucgauuccugggugaaccaguucuacacacuggcccccaugggcaauggaaccggccgcaagcgguga

SEQ ID NO: 30439 - RNA, 1614 nt, Artificial Sequence
  derived and/or modified sequence opt5 from VP1__Norovirus_and/or_Norovirus-like__KX514306
augaagauggccagcuccgacgcuaaccccucugauggcagcaccgccaaucuggugccugaggucaacaaugaaguuauggcgcucgagccgguggugggggucgcuaucgccgcccccguggcuggacagcaaaacguuauugacccuuggaucagaaauaacuucgugcaggcccccggcggggaauuuacagucuccccucggaaugcucccggagagauucuguggucugccccucuuggcccggaucugaaccccuaccucagccaccuggcgcgcauguauaauggguacgccggaggcuucgaagugcagguuauccuugcuggcaacgccuuuacggcugggaaaauuaucuucgccgcggugccucccaccuuuccuacagagggacugucccccucucaggucaccauguucccgcauaucauuguggacgugagacaacucgagccuguccugaucccccugccugauguucggaauaacuuuuaucacuacaaucagagcaacgacuccacaauuaagcucaucgccaugcuguauacaccccuucgcgcuaauaaccccggcgaugacguguucauugugagcugcagaguccugacccggccuucuccggauuuugacuucaucuuucucgugcccccuaccguugaaucccgcacgaaacccuucagcgugccuauucugaccgucggggagaugacaaacucuagauuucccaucaaucuugaacggcuguucaccggaccguccagcgccaacgugguucagccucagaauggccgcuguacaaucgauggggagcuccugggaaccacgcaacugucuuccgugaacauuugcacauucagaggcgacgucacccagaucggcagcacacagcauuggaccaugaaucucgcuucccccaacuggaauaacuacgauccuaccgaggaaacacccgccccucuggggacgcccgacuuugugggaaagauucagggcaugcuuacccaaacaacccaggagaaugggucuacacgggcccaccgcgcuaccgucuaugugggaggcgcgaacuacgccccgaaacuggggaagguucaguucgaaacggacacaggagaugaccucgcuaucagacaaaauaccaaguuuaccccugugggcgucauucagagcuccgaucaucaccgggacgagccccagcaguggcgccugcccaacuacagcggcgccaauacauucaacgugcaccuugccccugcuguugccccgaauuuucccggggaacaacuccucuucuuuagaucuacccugccuggauguggcgggcaucccaacauggaucuggacugccuccugccucaggagugggugcagcacuucuaucaggaggcggcucccgcccaauccgaugucacacuucugcgguuugugaacccugacacgagcagagugcuguucgaauguaaacugcauaagucuggauacguuaccgucgcccacacaggccaguaugaucuugugcugcccagcaauggguacuuucgcuucgacuccugggugaaccaguuuuauacccucgcuccgaugggcaauggaacaggccggagacgcuga

SEQ ID NO: 30440 - RNA, 1614 nt, Artificial Sequence
  derived and/or modified sequence opt5 from VP1__Norovirus_and/or_Norovirus-like__AB186063
augaagauggccagcaacgacgugaaucccuccgauggcucugcugccaaccuggucccugagguuaauaacgaagugauggcgcucgagccgguggucggggcugccaucgccgcucccguggccggacagcaaaauauuaucgacccuuggauuagaaacaauuucguucaggcucccggcggggaauuuaccgugagcccucggaacgcccccggagagauccugugguccgcgccucuuggcccggaucugaaucccuaccucucucaccugagccgcauguauaacggguacgccggaggcuucgaaguccaggugauucuugcuggcaaugccuuuacagcugggaaaguuaucuucgccgcggugccucccaacuuuccuacggagggacugucccccucucaggucaccauguucccgcauaucauuguggacgugagacaacucgagccuguccugaucccccugccugauguucggaauaacuuuuaucacuacaaucaggcccaugacagcacacucaagcugauugcuaugcuuuauacaccccugcgcgccaacaacgcuggcgaugacguguucaccguguccugcagaguccucacccggcccagcccugauuuugacuucaucuuucuggugccgcccacaguugaaucucgcaccaaaccuuucacggugcccguccuuaccguggaggaaaugacaaauuccagauuuccuauuccccuggagaagcucuacaccgggccgagcucugccuucguugugcagccucagaacggacgguguacaaccgauggcguccugcuggggacgacacaacucuccgccgugaauaucugcaccuuccgcggagacgucacacacauugcuggcagcagaaacuauaccaugaaucuggcgucucagaacuggaauaacuacgaucccaccgaggaaaucccugcuccccuuggcacaccugacuuuguggggaaaauccagggacugcucacgcagaccacacgggccgacggcuccacccgcgcccauaaggccacaguuagcaccggguccgugcacuucacgcccaagcugggaucuguccaauuuagcacagauaccgacaaugauuuccagccgggccagaacaccaaauuuacaccuguggggguuauucaagacggagauagacaccagaaugagccccagcagugggugcuucccgacuacuccggccggaccggccauaacguccaccuggcuccugccguggcgccgacauuccccggggaacaacuccuguuuuuccgcagcacgaugccuggauguucuggcuaucccaauaugaaccuggauugccuccugccucaggagugggugcuucauuuuuaccaggaauccgcucccgcccagagcgacguugcccugcucagauucgucaauccugauaccaaccgggugcuguuugaguguaagcuccacaaaucuggguauaucacaguggcucacaccggacaacaugaccugauucuucccccgaacggcuacuucagauuugauagcugggucaaucaguucuauacacuggccccuauggggaacggcgcuggacgccggagauga

SEQ ID NO: 30441 - RNA, 1614 nt, Artificial Sequence
  derived and/or modified sequence opt5 from VP1__Norovirus_and/or_Norovirus-like__AF406793
augaagauggccagcuccgacgcuaaccccucugauggcagcaccgccaaucuggugccugaggucaacaaugaaguuauggcgcucgagccgguggugggggcugccaucgccggacccgucgcuggccagcaaaacgugauugacccuuggaucagaaauaacuucguucaggcccccgggggagaauuuacaguguccccuacgaaugcucccggcgagauucuguggucugccccucuugggccggaucugaaccccuaccucagccaccuggcgcggauguauaauggauacgccggcggcuucgaaguccaggugauccuugcugggaacgccuuuaccgcuggaaaaauuaucuucgccgcgguuccucccaauuuuccuacagagggccugucccccucucaggugaccauguucccgcauaucauugucgacgugcgccaacucgagccugugcugaucccccugccugaugccagaaacaauuuuuaucacuacaaccagagcaaugacuccacaauuaagcucaucgcuaugcuguauacaccccuucgggccaacaacgcuggggaugacgucuucaccguuagcugccgcgugcugaccagacccucuccugauuuugacuucauuuuucucgugccgcccacggucgaaucccggaccaaaccuuucacagugcccauccugaccguugaggaaaugagcaauucucgcuuuccuauuccccuugagaagcuguacacaggaccguccagcguguucgucgugcagccucagaacggcagauguaccacggaugggguucuccugggaacaacccaacugucugccgugaauaucugcacauuccggggcgacgucacccauaucgccggcucccacgauuauaccaugaaccucgcuagccagaauuggaacaauuacgaccccacagaggaaauuccugcgccccuggggacgccugacuuugugggaaaaauccagggcaugcuuacccagacaacccgcgaggauggguccacaagagccaccaaggcuacggucucuacaggaagcgugcauuucacccccaagcugggcuccguucaauacaccgccgacacaaacaaugauuuucagaccgggcagaacacaaaauucacgccggugggagucauucaagacggcagcaaucaccagaacgaaccucagcagugggugcucaccaauuauucuggccggacagggcacaacguucaucuggcccccgcuguggcccccaccuuuccuggagagcaacuucuguucuuucgcuccacaaugccgggcuguagcggguaccccaauaugaaccucgauugccugcugccucaggaauggguccagcacuucuaucaggaggcggcucccgcccaaucugacguggcccuccugagauuugugaacccugauaccggacggguucuuuucgaguguaagcugcauaaaagcggcuacgucacgguggcucacaccgggccccacgaccucgugaucccucccaauggcuauuuucgcuucgauccgugggucaaccaguuuuacacacuggccccuaugggaaauggcgcugggagacggagauga

SEQ ID NO: 30442 - RNA, 1614 nt, Artificial Sequence
  derived and/or modified sequence opt5 from VP1__Norovirus_and/or_Norovirus-like__KX514223
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaccuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaaccccggcgaugacguuuucaccgugagcugcagagugcugacccggccuucuccggauuuugacuucauuuuucucgugcccccuacggucgaaucccgcaccaaacccuucagcguuccuauccugacagugggggagaugaccaacucuagauuucccauuaaucuugaacggcuguucacaggaccguccagcgcuaacgucgugcagccucagaauggccgcuguaccaucgauggggagcuccugggaacgacacaacugucuuccguuaacaucugcaccuucagaggcgacgugacacauauuggcagcacccaccauuggaccaugaaucucgccucccccaacuggaauaacuacgauccuacagaggaaacgcccgccccucuggggacccccgacuuugucggaaagauccacggcaugcuuacacagaccacacaggggucuggaagcacccgggcucaccgcgcgacgguguaugucggcuccgccgacuucacaccgaaacuggggaaggugcaguuugagaccgaaaccgaucaugaccucgcuauuagacaaaauacaaaguucaccccuguuggagugauccaggagagcgaucaccaucgggacgaaccccagcaauggcgccugcccaacuacucuggcgccaauacauuuaacguccaccuugccccugcuguggccccgaauuuccccgaugagcagcugcucuuuuucagauccacgcugccuggcugugggggacaccccaacauggaccuggauugccuccugccucaggaguggguucagcauuuuuaccaagaagcggcucccgcccagagcgacguggcccuucugcgguucgucaauccugauaccucuagagugcucuuugaguguaaacugcacaagagcggcuaugugacaguugcucauaccgggcagcacgaccuugucauucccccgaacggauacuuccgcuuugauuccugggugaaccaguucuauacacuggccccuaugggcaaugggaccggccggaaaagauga

SEQ ID NO: 30443 - RNA, 1614 nt, Artificial Sequence
  derived and/or modified sequence opt5 from VP1__Norovirus_and/or_Norovirus-like__KX514318
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccacguuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaaccccggcgaugacguuuucaccguguccugcagagugcugacacggccuagcccggauuuugacuucauuuuucucgugcccccuaccgucgaaucucgcacgaaacccuucuccguuccuauccugaccgugggggagaugacaaauagcagauuucccgucaaccuugaacggcuguucaccggaccgucuuccgccaaugugguucagccucagaacggccgcuguaugauugauggggugcuccugggaacaacccaacugagccccgucaauaucugcacguucagaggcgacgugacacauccuggcgggucuaagaucuacaccaugaaccucgccucccccaauuggaacaauuaugauccuacagaggagauucccgcuccgcugggaaccccugacuuugucggcaaaauccacgggaugcuuacccagacaacgcaggaaaacggaagcacccgggcgcaucgcgccacaguguacguuggcggggcuaauuucacccccaagcugggaaaggugcaguuugagacagacaccgaagaugaccucgccauuagacaaaacacgaaauucacacccgucggcgugauccaguccucugaucaccaccgggacgagccucagcaauggcgccugccgaauuacagcggcagagauacccccaacguucaucuugccccuaccguggcucccaauuuuccuggggaacagcuccuguucuuucgguccacacugcccggauguggcgggcacccuaacauggaccuggauugccuccugccccaggaguggguccagcauuucuaucaagaggccgcgccggcucagagcgacgugacccuucugagauuugugaacccugauacaucucgcguucucuucgaauguaagcugcacaaauccggauacgucacgguggcccacaccggccagcaugaccuugugauucccccuaauggguauuuucgguucgauagcugggucaaccaguuuuacacacuggcccccaugggcaauggaaccggcagaaagcgcuga

SEQ ID NO: 30444 - RNA, 1614 nt, Artificial Sequence
  derived and/or modified sequence opt5 from VP1__Norovirus_and/or_Norovirus-like__AB186065
augaagauggccagcaacgacgugaaucccuccgauggcucugcugccaaccuggucccugagguuaauaacgaagugauggcgcucgagccgguggucggggcugccaucgccgcucccguggccggacagcaaaauauuaucgacccuuggauuagaaacaauuucguucaggcucccggcggggaauuuaccgugagcccucggaacgcccccggagagauccugugguccgcgccucuuggcccggaucugaaucccuaccucucucaccugagccgcauguauaacggguacgccggaggcuucgaaguccaggugauucuugcuggcaaugccuuuacagcugggaaaguuaucuucgccgcggugccucccaacuuuccuacggagggacugucccccucucaggucaccauguucccgcauaucauuguggacgugagacaacucgagccuguccugaucccccugccugauguucggaauaacuuuuaucacuacaaucaggcccaugacagcacacucaagcugauugcuaugcuuuauacaccccugcgcgccaacaacgcuggcgaugacguguucaccguguccugcagaguccucacccggcccagcccugauuuugacuucaucuuucuggugccgcccacaguugaaucucgcaccaaauccuucacggugccuguccuuaccguggaggaaaugacaaauagcagauuucccauuccucuggagaagcucuacaccgggcccucuuccgccuucguugugcagccgcagaacggacgguguacaaccgauggcguccugcuggggacgacacaacucagcgccgugaauaucugcaccuuccgcggagacgucacacacauugcuggcucuagaaacuauaccaugaaucuggcgucccagaacuggaauaacuacgauccuaccgaggaaauccccgccccucuuggcauccccgacuuuguggggaaaauucagggacugcucacacagacgacccgggcugacggcagcacacgcgcccauaaggccaccguuuccacagggucugugcacuucaccccuaagcugggaagcguccaauuuuccacggauacagacaaugauuuccagcccggccagaacaccaaauuuaccccgguggggguuauccaagacggagauagacaccagaaugagccucagcagugggugcuucccgacuacagcggccggacaggccauaacguccaccuggcucccgccguggcgccuaccuucccgggggaacaacuccuguuuuuccgcucuacaaugcccggauguuccggcuauccuaauaugaaccuggauugccuccugccccaggagugggugcuucauuuuuaccaggaaagcgcuccugcccagucugacguugcccugcucagauucgucaaucccgauacgaaccgggugcuguuugaguguaaacuucacaagagcggguauauuaccguggcucacacaggacaacaugaccugauccucccucccaacggcuacuucagauuugauuccugggucaaucaguucuauacccuggccccgauggggaacggcgcuggacgccggagauga

SEQ ID NO: 30445 - RNA, 1614 nt, Artificial Sequence
  derived and/or modified sequence opt5 from VP1__Norovirus_and/or_Norovirus-like__KX514307
augaagauggccagcuccgacgcuaaccccucugauggcagcaccgccaaucuggugccugaggucaacaaugaaguuauggcgcucgagccgguggugggggcugccaucgccgcucccgucgugggacagcaaaacguuauugacccuuggaucagaaauaacuucgugcaggcccccggcggggaauuuacagucuccccucggaaugcucccggagagauucuguggucugccccucuuggcccggaucugaaccccuaccucagccaccuggcgcgcauguauaauggguacgccggaggcuucgaagugcagguuauccuugcuggcaacgccuuuacggcugggaaaauuaucuucgccgcggugccucccaccuuuccuacagagggacugucccccucucaggucaccauguucccgcauaucauuguggacgugagacaacucgagccuguccugaucccccugccugauguucggaauaacuuuuaucacuacaaucagagcaacgacuccacaauuaagcucaucgccaugcuguauacaccccuucgcgcuaauaaccccggcgaugacguguucaccgugagcugcagaguccugacccggccuucuccggauuuugacuucauuuuucucgugcccccuacgguugaaucccgcaccaaacccuucagcgugccuauccugacagucggggagaugaccaacucuagauuucccauuaaucuugaacggcuguucacaggaccguccagcgccaacgugguucagccucagaauggccgcuguaugaucgauggggugcuccugggaaccacgcaacugucucccgucaacaucugcacauucagaggcgacgugacccauccuggcggguccaagauuuacacaaugaaucucgcuagccccaacuggaauaacuaugauccuaccgaggagacccccgccccgcugggaacaccugacuuugucggcaaaauccacgggaugcuuacgcagaccacacaggaaaauggauccacccgggcccaucgcgcuacaguguacguuggcggggcgaacuucacccccaagcugggaaaggugagauuugagacggacacaggcgaugaccucgccauucggcagaauaccaaauucacccccgucggcgugauccaaucuagcgaucaccaccgcgacgaaccucagcaguggagacugccgaacuacuccggggcuaauacauuuaacguucaucuugcccccgccguggcuccuaauuuccccggagagcaacugcucuuuuuccggagcacccugccuggcugugggggacaccccaacauggaucuggacugccuccugccucaggaauggguccagcauuuuuaucaggaggccgcgcccgcucaaucugauguggcccuucugagauucgugaacccggacacaucccgcguucucuuugaguguaagcugcacaaaagcggcuacgucacgguggcccacaccgggcaguaugaucuugugcugccuucuaauggcuacuuccgguuugacagcugggucaaccaguucuauacacucgcucccaugggaaauggcaccgggagacgccgguga

SEQ ID NO: 30446 - RNA, 1614 nt, Artificial Sequence
  derived and/or modified sequence opt5 from VP1__Norovirus_and/or_Norovirus-like__LC048948
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacaucaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccagucccaugacagcacacucaagcugauugcuguucuuuauacaccccugcgcaccaauaacgccggcgaugacguguucaccgugucuugcagaguccucacacggcccuccccugauuuugacuucaucuuucuggugccgcccaccguugaaagccgcacgaaaccuuucaccgugcccauucuuacagucgaggaaaugucuaacuccagauuuccuaucccccuggagaagcucuacaccgggccgagcucugcuuucgugguucagccucagaauggacgguguacaaccgauggcgugcugcuggggacgacacaacucuccgccgucaacauuugcaauuuccgcggagacgugacccacaucgucggcagccaugagacaaccaugaaccuggccucccagaauuggucuaacuaugaucccacccagaaaaucccugcuccccuuggcacaccucacuuuguggggaagauucagggacugcucacgcaaaccacaagagcgcacggcagcacccgggcccauaaggcuacaguuuccaccgggagcgugcacuucacgcccaaacugggaucuguccaguuuacaaccgacaccaauaacgacuuccagacaggccaaaauaccaaguuuacaccgguggggguuauccaggauggagaccaucaccagaacgaaccucagcaaugggugcuucccaauuacuccggccgcacgggccacaacguccaucuggcccccgccguggcuccuaccuucccgggggagcagcuccuguuuuucagaagcacaaugcccggauguucuggcuacccuaauaugaaccuggauugccuccugccccacgaaugggugcuucauuuuuaucaggaggccgcgccugcucagagcgacguugcccugcuccgguucgucaaucccgauaccgggcgcgugcuguuugaauguaaacuucacaaguccggauacauuacaguggcccauaccggcccuuucgaccuggggauucccccgaacggcuauuuuagauucgauucuugggucaaccaauucuacacgcucgcuccuaugggaaauggcaccgggcggagacgcuga

SEQ ID NO: 30447 - RNA, 1614 nt, Artificial Sequence
  derived and/or modified sequence opt5 from VP1__Norovirus_and/or_Norovirus-like__LC048908
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacauuaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccagucccaugacagcacacucaagcugauugcuaugcuuuauacaccccugcgcgccaauaacgcuggcgaugacguuuucaccgugucuugcagagugcucacccggcccuccccugauuuugacuucaucuuucuggucccgcccacaguggaaagccgcaccaaaccuuucacgguucccauucuuaccguggaggaaaugucuaacuccagauuuccuaucccccuggagaagcucuacacagggccgagcucugccuucgucgugcagccucagaauggacgguguaccacagauggcguucugcuggggaccacgcaacucuccgccgugaacauuugcaauuuccgcggagacgucacacacaucgugggcagccaugauuauaccaugaaccuggcuucccagaauuggucuaacuacgaccccacagaggaaaucccugcgccccuuggcaccccugacuuugucgggaaaauucagggacugcucacccagacaacgagagcccacggcagcacccgggcucacaaggccacaguguccaccgggagcguucauuucacacccaagcugggaucugugcaauuuaccacggauacaaauaacgacuuccagaccggccagaauaccaaauuuacaccggucggggugauccaagauggagaccaccaucagaacgagccucagcaguggguucuucccaauuacuccggccgcaccggccacaacgugcaccuggcccccgcugucgccccuacauucccgggggaacaacuccuguuuuucagaagcacgaugcccggauguucuggcuauccuaauaugaaccuggauugccuccugccccaggagugggugcuucauuuuuaccaggaaaccgcgccugcucagcccgacguggcccugcuccgguucguuaauccugauacaagccgcguccugugugagugcaaacuucccaaguccggguauauuaccguggcccacacaggaccguacgaccuggugaucccucccaacggcuauuuuagauucgauucuugggucaaccaauuuuacacccucgcuccuauggggaauggcacgggacggagacgcuga

SEQ ID NO: 30448 - RNA, 1614 nt, Artificial Sequence
  derived and/or modified sequence opt5 from VP1__Norovirus_and/or_Norovirus-like__KX514312
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccacguuuccuaccgagggacugucccccucucaggugacaauguucccgcauaucauugucgacgugagacaacucgagccugugcugaucccccugccugauguccggaauaacuuuuaucacuacaaucagagcaacgacuccaccauuaagcucaucgccaugcuguauacaccccuucgcgcuaauaaccccggcgaugacguuuucaccgugagcugcagagugcugacacggccuucuccggauuuugacuucauuuuucucgugcccccuaccgucgaaucccgcagcaaacccuucucuguuccugugcugacggucgaggaaaugaccaacuccagauuucccgccacacuugauaagcuguucaccgggccgagcucuacauucgugguucagccucagaauggacgguguaugaucgacggcgugcuccuggggaccacgcaacugucccccgucaacauuugcacauuucgcggagaugugacccauccuggcggcagcaaaaucuacacaaugaaucucgccucccccaacuggaauaacuaugacccuaccgaggagauccccgcuccgcuggggaccccugacuucgucggaaagauucacggcaugcuuacacagacgacccaggaaaaugggucuacaagagcgcaucgggccaccguguacguuggaggcgcuaacuuuacacccaagcuggggaaagugcaguucgagaccgauacgggagacgaucucgccauccgccaaaauacaaaguuuacccccgucggcgugauucagagcuccgaccaccacagagaugaaccucagcaauggcggcugccgaacuacagcggccgcgacacccccaauguucaucuugccccugcuguggcccccacauucccuggggagcagcugcucuuuuucagaucuaccauccccggauguggcgggcacccuaacaugaaucuggauugccugcucccccaggaauggguccagcauuuuuaucaagaggcggcuccggcccaguccgacguggcccugcuucgguucgugaacccugauacaagcagaguucuguuugaguguaaacuccacaagucuggauacgucacgguggcucacaccggccagcaugaccuggugauucccccuaauggguauuuccgcuuugauagcugggucaaccaguucuacacacuugcccccaugggcaacggaaccggccggaaaagauga

SEQ ID NO: 30449 - RNA, 1614 nt, Artificial Sequence
  derived and/or modified sequence opt5 from VP1__Norovirus_and/or_Norovirus-like__KX514237
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuuguuggcaaugcuuuuacagccgggaaaauuaucuucgcggccgugccucccaacuuuccuacggagggacugagccccucccaggucaccauguucccgcauaucauuguggacgugagacaacucgagccuguccugaucccccugccugauguucggaauaacuuuuaucacuacaaucagucuaacgacagcacaauuaagcucaucgcuaugcuguauacaccccuucgcgccaacaaugcuggcgaugacguguucaccguguccugcagaguccugacccggcccagcccugauuuugacuucauuuuucucgugccgcccacaguugaaucucgcuccaaaccuuucagcgugcccguccugaccguggaggaaaugacgaacucuagauuuccugccacccuugauaagcuguucacagggcccuccagcaccuucguugugcagccgcagaauggacgguguaugaucgacggcguccuccuggggacaacccaacugucuccugugaacauuugcacguuucgcggagaugucacacaucccagagacuccccuaucuacaccaugaaucucgccagccccaacuggaauaacuaugacccuacagaggagauccccgcuccgcugggcaccccugauuucgugggcaaaauucaggggaugcuuacccagacaacgcagggauccggcucuacccgggcgcaccgcgccacaguuuacguggggagcgcugacuuuacccccaagcugggaaagguccaauucgaaacagagaccgaucaugaccucgccaucagacagaauacgaaauuuacacccgugggcguuauucaggaauccgaucaccaccgggacgagccucaacaguggcgccugccgaacuacagcggggccaauaccuucaacgugcaucuugcucccgccgucgcgccuaauuuucccggagaacagcuucucuucuuuagaucuacccugcugggcuguggcgggcacccuaacauggaucucgacugccugcuuccccaggagugggugcaacauuucuaucaggaggcugccccugcccaguccgauguggcucugcuccgguuuguuaaucccgacacaagcagaguccuguucgaauguaagcugcacaaaucuggauacgugaccguggcccacacaggccaguaugaucugguccucccgagcaacggguacuuucgcuucgacuccugggugaaccaauucuauacgcuggcuccuaugggaaauggcaccgggcggagacgcuga

SEQ ID NO: 30450 - RNA, 1614 nt, Artificial Sequence
  derived and/or modified sequence opt5 from VP1__Norovirus_and/or_Norovirus-like__DQ419907
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauuccucuguucaggcucccggcggggaguucacagugagcccucgggaugcccccggagaaauucugugguccgcgccucuuggcccggaccugaaccccuaccucucucaccuggcccgcauguauaauggguacgcuggaggcuuugaaguccaggugauccuugccggcaacgcuuucacggccgggaaaauuaucuuugcggccgcuccucccaauuucccuaccgagggacugagccccucccagguuacaauguuuccgcauaucauugugggcgucagacaacucgagccugugcugaucccccugccugaugugcggaacaauuucuaucacuacaaccagagcaaugacucuaccauuaagcucaucgccaugcuguauacaccccuucgcgcuaacaaugccggggaugacgucuuuaccguuuccugcagagugcugacacggcccagcccugauuucgacuuuauuuuccucgugccgcccaccgucgaaucucgcacgaaaccuuuuaccgugcccauccugacaguugaggaaaugaccaacuccagauucccuauuccccuugagaacuguagccgggugccggccgucccucugucuuccaaucauaagaugcagugcacaaccgauggagugcuccugggcacgacacagcugagccccguuaacaucuguaccuuucgcggggacgugacacacaucccuggaaccagaaccuaccggaugaaucucgcuucccaaaacuggaauaacuaugaucccacagaggaaauuccugcgccccugggcacgccggacuucgucggcaaaauccaggggaugcuuacccagacaaccaagggagacggcucuacacgcgggcauaaggccaccgugagcacgggauccgucgauuucacaccuaaacugggcagcgugcaguuugcuaccgacaccgauaaugacuucgagacagggcaaaacaccagauuuacacccguuggagugauucaggaugggucuuccacgcaccggaaugaaccccagcaauggguccucccugacuacagcggccgcaccgugcacaacguucaucuggccccggccguggcucccacauucccuggcgagcagcuucuguuuuucagaucuaccaugcccggaugcagcggcuacccuaauauggaucucgacugucugcugccccaggaauggguccagcacuuuuaucaagaggccgcgccuucccagucugauguggcucuccugcgguucgugaaccccgacacagggagaguucuuuuugagugcaagcugcauaaagccggauacgucaccguggcccacacgggccagcacgaucucgugaucccgccuaauggguauuuccgcuuugacagcugggucaaccaguucuacacccuggcucccaugggcaauggagccggccggagacgcuga

SEQ ID NO: 30451 - RNA, 1614 nt, Artificial Sequence
  derived and/or modified sequence opt5 from VP1__Norovirus_and/or_Norovirus-like__JN975543
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugcuucagccccggcugugcacccaugcucgcuggccugcgcccguuuacggccuccugguggacccuucucuucccuccaauccgcaauggcagaacgggagaguccacguggauggaacacugcucggcaccacgccuguuagcggcucuuggguguccuguuucgccgcugaagccgccuaugaguuucagagcgggacaggagaggucgcuaccuucacacugauugaacaagacggcaccgccuacgugcccggggaucgggcggcuccucugggauaccccgacuuuucuggccagcucgagaucgaaguccagaccgagacaacgaaggccggggacaaacugaaggugaccacauucgaaaugauucuuggaccuaccacaaauguugaucaggcccccuaucaaggccgcguguacgcuuccaucaccgccauggcuagccuggaccucgucgauggcagagugcgggccguuccgcgcuccauuuauucuuuccaggacgugaucccugaguacaacgaugggcugcuugucccccuggcgcccccuaucggaccguuucuccccggcgaggugcugcugagauuccggacguauaugagacagcucgacacagccgaugcugccgcugaagccauugacugcgcgcugccucaggaguuuaucagcugguucgccuccaaugcuuuuaccgugcaaagcgaagcccuucugcuccgcuaccggaacacccugacagggcagcugcuuuucgaguguaagcucuauucugaaggauacauugcucuguccuacagcggcucuggggcccugaccuuucccacagauggcuucuuugagguugucagcugggugccuagacucuaucagcuggccuccgugggaucucuugcuacgggccgcuga

SEQ ID NO: 30452 - RNA, 1614 nt, Artificial Sequence
  derived and/or modified sequence opt5 from VP1__Norovirus_and/or_Norovirus-like__JN975541
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugcuucagccccggcugugcacccaugcucgcuggccugcgcccguuuacggccuccugguggacccuucucuucccuccaauccgcaauggcagaacgggagaguccacguggauggaacacugcucggcaccacgccuguuagcggcucuuggguguccuguuucgccgcugaagccgccuaugaguuucagagcgggacaggagaggucgcuaccuucacacugauugaacaagacggcaccgccuacgugcccggggaucgggcggcuccucugggauaccccgacuuuucuggccagcucgagaucgaaguccagaccgagacaacgaagaccggggacaaacugaaggugacaaccuucgaaaugauucuuggaccuacaaccaauguugaucaggcccccuaucaaggccgcguguacgccuccaucacggcugccgcuagccuggaccucgucgauggcagagugcgggccguuccgcgcuccauuuauucuuuccaggacgcgaucccugaguacaacgaugggcugcuugugccccuggcucccccuaucggaccguuucuccccggcgagguccugcugagauuccggacauauaugagacagcucgacaccgcugaugccgcugccgaagcgauugacugcgcccugccucaggaguuuaucagcugguucgcuuccaaugccuuuaccgugcaaagcgaagcccuucugcuccgcuaccggaacacacugaccgggcagcugcuuuucgaguguaagcucuauucugaaggauacauugcccuguccuacagcggcucuggggcccugacauuucccacggauggcuucuuugaggugguuagcugggucccuagacucuaucagcuggcuuccgugggaucucuugcgaccggccgcuga

SEQ ID NO: 30453 - RNA, 1614 nt, Artificial Sequence
  derived and/or modified sequence opt5 from VP1__Norovirus_and/or_Norovirus-like__KF113526
augagaaugagcgacggcgccgcucccaaggccaacggguccgaggcgucuggacaggaucuggugccuaccgcugucgaacaagccguuccgauccagcccguggccggcgcuagccucgccgcuccugccgcggggcagauuaaucagaucgaccccuggauuuuccaaaacuuugugcagugcccucugggagaguucuccaucucuccccggaauacaccuggcgaaauucuuuuugaucuggcccucgggccgggacugaaccccuaccuugcucaccugagcgccauguauacgggcugggucggcaauauggaggugcagcucguucuggcugggaacgccuucaccgcgggaaaaguggucguggcccugguuccucccuacuuuccuaagggcucccucacagcugcccagaucaccuguuucccccaugugaugugcgacguccgcacacuggaaccgauccaacuuccucugcucgaugugagacgggugcuguggcacgcuacccaggaccaggaggagucuaugcgccuugucuguaugcuguauacaccccucagaaccaauagcccuggggaugaauccuuuguugugagcggacggcugcugucuaaacccgccgccgacuucaacuuuguguaccucacgcccccuauugagcgcaccaucuauagaauggucgaucugccggugcuucagccccggcugugcacacaugcucgcuggccugcgcccguuuacggccuccugguggacccuucccuucccagcaauccgcaauggcagaacgggagaguccacguggauggaacccugcucggcacaaccccuguuucuggcuccugggugagcuguuucgccgcugaagccgccuaugaguuucagucugggacgggagaggucgcuacauucacccugauugaacaagacggcuccgccuacgugcccggggaucgggcggcuccucugggauaccccgacuuuagcggccagcucgagaucgaaguccagacagagaccaccaaggccggggacaaacugaaggugacaacguucgaaaugauucuuggaccuaccacaaauguugaucaggcccccuaucaaggccgcguguacgcuucccugaccgccgcugccucucucgaccuggucgauggcagagugcgggcgguuccgcgcagcaucuauggguuccaggaccagauuccugaguacaacgauggacuucuggugccccucgcucccccugucggcccguuucugcccggggagcugcuccugagauuccggacauauaugagacagaucgacuccgccgaugccgcugccgaagcgaucgacugcgcccuuccucaagaguuuauuagcugguucgcuucuaaugccuuuaccgugcaguccgaagcucugcuccugcgcuaccggaacacgcugacaggacagcuucucuucgaguguaagcuguauagcgaaggcuacaucgcccugucuuacagcggguccggcccccucaccuuuccuaccgauggauucuuugaggugguuucuuggguccccagacuguaucagcuugccagcgugggcucccuggcuacagggcgcuga

SEQ ID NO: 30454 - RNA, 1614 nt, Artificial Sequence
  derived and/or modified sequence opt5 from VP1__Norovirus_and/or_Norovirus-like__KF113527
augagaaugagcgacggcgccgcucccaaggccaacggguccgaggcgucuggacaggaucuggugccuaccgcugucgaacaagccguuccgauccagcccguggccggcgcuagccucgccgcuccugccgcggggcagauuaaucagaucgaccccuggauuuuccaaaacuuugugcagugcccucugggagaguucuccaucucuccccggaaugccccuggcgaaauucuuuuugaucuggcucucgggccgggacugaaccccuaccuugcccaccugagcgcuauguauacaggcugggucggcaauauggaggugcagcucguucuggccgggaacgcguucacggccuccaaaguggucguggcucugguuccucccuacuuuccuaagggaucucucaccacagcccagaucaccuguuucccccaugugaugugcgacguccgcacacuggaaccgauccaacuuccucugcucgaugugagacgggugcuguggcacgcuacccaggaccaggaggagagcaugcgccuugucuguaugcuguauacaccccucagaaccaauuccccuggcgaugagagcuuuguugugucugggcggcugcuguccaaacccgccgccgacuucaacuuuguguaccucacgcccccuauugaacgcaccaucuauagaauggucgaucugccggugcuucagccccggcugugcacacaugcucgcuggccugcgcccguuuacggacuccugguggacccuagccuucccucuaauccgcaauggcagaacggcagaguccacguggaugggacccugcucggaacaaccccuguuuccggcagcugggugucuuguuucgccgcugaagccgccuaugaguuucaguccggcacgggggaggucgcuacauucacccugauugaacaagacggaagcgccuacgugcccggcgaucgggcggcuccucugggguaccccgacuuuuccggacagcucgagaucgaaguccagacagagaccaccaaggccggcgacaaacugaaggugacaacguucgaaaugauucuugggccuaccacaaauguugaucaggcccccuaucaaggacgcguguacgcuucucugaccgccgcugccagccucgaccuggucgauggcagagugcgggcgguuccgcgcuccaucuauggcuuccaggaccagauuccugaguacaacgaugggcuucuggugccccucgcucccccugucggaccguuucugcccggcgagcugcuccugagauuccggacauauaugagacagaucgacagcgccgaugccgcugccgaagcgaucgacugcgcccuuccucaagaguuuauuucuugguucgcuuccaaugccuuuaccgugcagagcgaagcucugcuccugcgcuaccggaacacgcugacagggcagcuucucuucgaguguaagcuguauucugaaggauacaucgcccugagcuacuccggcucugggccccucaccuuuccuaccgauggcuucuuugaggugguuagcuggguccccagacuguaucagcuugccuccgugggaagccuggcuacaggccgcuga

SEQ ID NO: 30455 - RNA, 1614 nt, Artificial Sequence
  derived and/or modified sequence opt5 from VP1__Norovirus_and/or_Norovirus-like__KM458057
augagaaugagcgacggcgccgcucccaaggccgauggguccgaggcgucuggacaggaccuggugccuaccgcugucgaacaagccguuccgauccagcccguggccggcgcugcccucgcugccccugcggccgggcagauuaaccagaucgaucccuggauuuuccaaaauuuugugcagugcccucugggagaguucagcaucagcccccggaacacaccuggcgaaauucuuuuugaccuggcucucgggccgggacugaaucccuaccuugcccaccugucugcuauguauacgggcugggucggcaacauggaggugcagcucguucuggccgggaaugcguucaccgccggaaaaguggucguggcucugguuccucccuacuuuccuaagggcagccucacaaccgcccagaucacauguuucccccaugugaugugcgauguccgcacccuggaaccgauccaacuuccucugcucgacgugagacgggugcuguggcacgcuacacaggaucaggaggaguccaugcgccuugucuguaugcuguauacgccccucagaaccaacucuccuggggacgaauccuuuguuguguccggacggcugcugagcaaacccgccgccgauuucaauuuuguguaccucacacccccuauugagcgcaccaucuauagaauggucgaccugccggugauucagccccggcuuugcacccaugcucgcuggccugcgcccguuuacggccugcucguggauccuucucugcccuccaacccgcaauggcagaaugggagaguccacguggacggaacacuucugggcaccacgccuguuagcggcucuuggguguccuguuucgccgcugaagccgccuaugaguuucagagcgggacaggacaagucgcuaccuucacacucaucgagcaggauggcucugccuacgugcccggggaccgggcggcuccucugggauaccccgacuuuuccggccagcuggaaauugagguccagaccgaaaccacaaagacgggggauaaacucaaggugaccacauucgagaugauccugggaccuaccacaaacguugaccaagcccccuaucagggcaagguguucgccagcauuaccgcugccgcuucccuugaucuggucgacggccgcgugagagccguuccgcggucuaucuacggguuucaggaugugaucccugaauauaaugacggacuccuggucccccuugcgcccccuauuggcccguuccugcccggggaggugcuccugcgcuuuagaacguacaugcggcagcuggauacagccgacgcugccgcugaggccaucgauugcgcgcucccucaagaguucauuagcugguuugccuccaacguguucaccguucagagcgaagcucugcuucugagauaucgcaauacccucacaggacagcugcuguuugaauguaaacuuuacucugagggcuauaucgcccucuccuacagcgggucuggcccccugaccuucccuacagacggauuuuucgaagucgugagcugggugccccggcuguaccagcucgcuuccgucggcucucuggccacggggagauga

SEQ ID NO: 30456 - RNA, 1614 nt, Artificial Sequence
  derived and/or modified sequence opt5 from VP1__Norovirus_and/or_Norovirus-like__AB662855
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacgggcaugccggaggcauggagguucaggugaugcuggcgggcaaugccuucacagcugggaaacuggucuuugccgcugugcccccucacuuccccguugaaaaccucucuccucagcagauuaccauguuuccccaugugaucauugaugucagaacacuggagccggugcuucugccucuccccgacgugcggaauaacuucuuucacuacaaucaaaaggaugacccuaaaaugcgcaucgucgccaugcuguauacaccccuuagaagcaacggauccggcgaugacguuuucaccgugucuugccgggugcugacccgccccagcccugauuuugacuucacguaccucgucccgcccaccguggaauccaagacaaaaccuuuuacccugcccauccugacacucggggagcugagcaauucuagauucccuguuuccauugaucagauguauaccagccccaacgaggugaucucuguccagugucagaacggacggugcacgcuugacggcgaacugcaagggacaacccagcuccagguguccggaauuugugccuuuaagggcgagguuacagcucaucugcacgauaaugaccaccuuuacaacgugaccaucaccaaucugaacggcagcccguucgacccuucugaagauguccccgcgccucucggggugcccgacuuccagggacgcgucuuuggcgugauuucccaaagagauaagcagaaugccgcugggcauaacgagccugccaaucggggacacgacgccguugugcccacauauacggcucaguacaccccgaaacugggccaaguccagaucgggacauggcagaccgaugaccuccaggugaaccaaccuguuaaguucacacccgugggacugaaugauaccgaacauuuuaaccagugggucgugccccgcuacgccggcgcgcugaaucuuaacacgaaucuggcuccuagcguggccccgguuuuccccggcgagagacuccuguuuuuccgguccuauauuccucuuaaagggggauacggcaaccccgccaucgacugccugcucccucaggaguggguccagcacuuuuaucaagaagcugcccccucuaugagcgagguggcucuggugcgcuacaucaauccugauacagggagagcccuguucgaagcgaagcuccaccgggccggauuuaugaccgucuccagcaacaccucugcucccgugguugugccggccaacggcuauuucagauuugacuccugggucaaucaguucuacagccuggcuccuauggggacaggcaacggauga

SEQ ID NO: 30457 - RNA, 1614 nt, Artificial Sequence
  derived and/or modified sequence opt5 from VP1__Norovirus_and/or_Norovirus-like__AB809997
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugaacgcgagggaaccggcgaagccaagaacgcuaaagggguguacauuucuacaaccagcggaaaguuuacaccgaagaucggcuccauugggcugcauagcaucaccgagaauguucacccuaaccagcaaucuagauucacgcccgugggagucgcccagaaugagaacacacccuuccagcagugggugcuuccucauuaugccggcgcucuggcccucaauaccaaccuggcgccggcugucgcccccaccuuuccuggcgaacaacuucuguucuuucggucccgcgugcccugcguucaggggcucagaggacaggacgccuucaucgauugucugcugccucaggagugggugaaucacuuuuaccaagaagcugcccccagccaggcugacgucgcccucauucgguaugugaacccugauacaggcagaacccuguucgaggcgaaacuucaccgcucuggguuuaucacaguuagccauacgggagccuacccccugguggucccgccuaacggccacuuccgguuugacuccugggugaaucaguucuauucucucgcucccauggggaccggcaacggauga

SEQ ID NO: 30458 - RNA, 1614 nt, Artificial Sequence
  derived and/or modified sequence opt5 from VP1__Norovirus_and/or_Norovirus-like__AB810001
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccgcggacaggacgccuucaucgauugucugcugccucaggaaugggucaaucacuuuuaccaagaggcugcccccucucaggcugacguggcccucauuagauauguuaacccugauacaggccggacccuguucgaagcgaaacuucacagaagcggguuuaucacagugucccauacgggagccuacccccuggucgugccgccuaacggccacuuccgcuuugacucuugggugaaucaguucuauagccucgcucccauggggaccggcaacggauga

SEQ ID NO: 30459 - RNA, 1614 nt, Artificial Sequence
  derived and/or modified sequence opt5 from VP1__Norovirus_and/or_Norovirus-like__AB809992
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccgcggacaggacgccuucaucgauugucugcugccucaggaaugggucgaccacuuuuaccaagaggcugcccccucucaggcugauguggcccucauuagauauguuaauccugacacaggccggacccuguucgaagcgaaacuucacagaagcggguuuaucacagugucccauacgggagccuacccccuggucgugccgccuaacggccacuuccgcuuugauucuugggugaaccaguucuauagccucgcucccauggggaccggcaauggauga

SEQ ID NO: 30460 - RNA, 1611 nt, Artificial Sequence
  derived and/or modified sequence opt5 from VP1__Norovirus_and/or_Norovirus-like__AY130761
augaagauggccagcaacgacgcuacccccuccgaugacggcgccgcggggcuggugccugaaaucaauaacgaagucauggcucucgagccgguugccggagccucuauugcugcccccguggugggccagcaaaauaucauugauccuuggaucagaaacaauuucguccaggcucccgccggggaauuuacagugagcccucggaacucccccggagagcugcuucuggaccucgaacugggcccugagcuuaauccguaccuggcgcaccucgcccgcauguauaacgggcaugcuggaggcauggagguucagauugugcuggccggcaaugcuuucacggccgggaaaauccuguuugcggccauucccccuucuuuccccuacgaaaaccucagcccugcucagcugaccaugugcccccacgucauuguggauguuagacaacuugagccggugcugcucccuaugcccgacauccggaaugucuuuuaucauuacaaccagaauaacuccccuaagcugcgccuuguggccaugcuguauacaccccucagagcuaauaacucuggagaugacguguucaccgucagcugucggguucugacacgccccuccccugauuuucaguucaccuuucuggugccgcccacaguggaaagcaaaaccaagaacuucacgcucccuguccugagagugucugagaugaccaauucccgguuucccguugugcuugaccagauguacacaagccgcaacgagaauauuaucguccaaccucagaacggcagaugcaccacagauggggaacugcucggaaccacgacacugcagucuguguccauuuguaauuuccggggcaccaugcaggccaaacuuaacgagcaaccccgcuaucagcugcagcucacaaaucuggacgggagcccgaucgauccuaccgacgacaugcccgccccucugggaacccccgauuuucaagcuaugcucuacggcguugcgucucagagauccagccgggacaacgccacacgcgcucacgaugcccagauugacacggccggcgauaccuucgcuccuaagaucggacaggugagauucaaguccucuagcgacgauuuugaccugcaugaucccacaaaauucaccccgaucggggucaauguggacgaucaacacccuuuucggcaguggucccuucccaacuacggcgggcaccuggcccucaauaaccaucuggcgcccgcugucacaccucuuuucccgggagaacagauucuguuuuucagaagccacauccccucugccggcgggcauaccgacggagccauugacugccuccugccucaggaguggaucgaacacuuuuaucaagaggcugcccccucccagagcgauauugcucuggugcgcuucaucaauccugacacgggccggguucuccuggaggccaaacuucacaagcagggcuuucugacaguggcggccucuggggaucaucccaucgucaugccuaccaacggauacuucagauuugaggcuugggugaaucccuucuauacccucgccccgguuggcacagggagcggacgccggagaauccaguga

SEQ ID NO: 30461 - RNA, 1611 nt, Artificial Sequence
  derived and/or modified sequence opt5 from VP1__Norovirus_and/or_Norovirus-like__KF806495
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccgugcugaccgucgaggaaaugacaaacuccagauuuccuaucccccuugagaagcuguucaccgggccgagcucugccuucgugguucagccucagaauggacgguguacaaccgauggcgugcuccuggggacgacacaacuguccgcugucaacauuugcaccuuucgcggagacgugacacaugucagcgauaaaaccuucgcgaugaaucucgccucucccaacuggaauaacuacgacccuaccgaggacauccccgcuccucugggcacacccgauuuugugggcagaauccacgggaugcuuacgcagaccacacggcgcgacggagccaccagaggccauaaggccacaguuuccaccgggggagcugauuucacgccgaagcugggcagcgugcgguauauuacagacaccaccgaugaccucgaaguccgcgagaauacaaaauuuaccccuaucggggugcugcacuccucuggagaacacagagccgagcccgaucaguggcggcuucccgaauacagcggcagaaacguucauaaugugcaccuggcgccugcugucgccccgacauuccccggcgagcagcuccuguuuuuccgcuccgcccugccuggguguggaggcuaccccaacacggaccucgauugccugcuuccucaagagugggugcagcauuuuuaucaggaagcugcccccgcucaaagcgacguggcccugcuccgguucguuaauccugauaccgggagaguccuguuugaguguaaacuucacaagucuggauacgugacaguggcgcacaccggcccccaugaccuggucauuccgccuaacggguauuuccgcuuugacuccugggugaaucaguucuacacacucgcccccaugggcaacggaaccggccggagacgcuga

SEQ ID NO: 30462 - RNA, 1611 nt, Artificial Sequence
  derived and/or modified sequence opt5 from VP1__Norovirus_and/or_Norovirus-like__KF806503
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcauuaucaagcucauugccaugcuguauacaccccuucgcgcuaacaaugccggcgaugacguuuucaccguguccugcagagugcugacacggcccagcccugauuuugacuucaucuuucucgucccgcccaccguggaaucucgcacaaaaccuuucaccguucccgugcugacggucgaugagaugaccaacuccagauuuccuauuccccuugaaaagcuguucacagggccgagcucugccuucgugguucagccucagaauggacgguguaccacagacggcgugcuccuggggaccacgcaacuguccgcugucaacaucugcacauuucgcggagaugugacccaugucagcgacaaaacauucgcgaugaaucucgccucucccaacuggaauaacuacgacccuaccgaggagauccccgcuccucugggcacccccgauuuugugggccggauucacgggaugcuuacacagacgaccagacgcgacggagccacaagaggccauaaggccaccguuuccacagggggagcugauuucaccccgaagcugggcagcgugcgguauaucacggacacaaccgaugaccucgaaguccgcgagaauaccaaauuuacaccuauuggggugcugcacuccucuggagaacacagagccgagcccgaucaguggcggcuucccgaauacagcggcagaaacguucauaaugugcaccuggcgccugcugucgccccgaccuuccccggcgagcagcuccuguuuuuccgcuccgcccugccuggguguggaggcuaccccaacacagaccucgauugccugcuuccucaagagugggugcagcauuuuuaucaggaagcugcccccgcucaaagcgacguggcccugcuccgguucguuaauccugauacggggagaguccuguuugaguguaaacuucacaagucuggauacgugaccguggcgcacacaggcccccaugaccuggucaucccgccuaacggguauuuccgcuuugacuccugggugaaucaguucuacacccucgcccccaugggcaacggaacaggccggagacgcuga

SEQ ID NO: 30463 - RNA, 1611 nt, Artificial Sequence
  derived and/or modified sequence opt5 from VP1__Norovirus_and/or_Norovirus-like__KF712506
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucaucgacccuuggaucagaaauaacuucgugcaggcccccggcggggaauuuacaguuuccccucggaaugcgcccggagaggugcuguggucugccccucuuggcccggaucugaaccccuaccucagccaccuggcucgcauguauaauggguacgccggaggcuucgaaguccaggugauucuugcuggcaacgccuuugcggccgggaaaaucauuuucgcugccguuccucccaauuuuuccacggagggacugucuccuagccaggugaccauguucccccaucucaucgucgacgugagacaacuggagccggugaugaucccucugcccgauauucggaacaauuuuuaucacuacaaccaguccaaugacccuacaaucaagcucauugcuaugcuguauacaccccuucgcgccaacaacgucggcgaugacguuuucaccgugagcugcagagugcugacccggcccucuccugauuuugacuucaucuuucucgucccgcccacaguggaauccaaaaccaauccuuucagcguucccauucugacgaucgaggaaaugaccaacucucgcuuuccuauuccccuugagaagcuguucacagggccguccagcgcccucgugguccagccucagaauggaagauguaccacagauggcgugcugcuggggaccacgcaacucucucccguuaacaucugcacauuccggggagacgugacccauacaaccaaaacccacacauaccagaugaaucuggcugcgcagaacuggaacuccuaugauccuacggaggaaauccccgccccucuuggcacccccgacuuugucggcaagauucagggggugcugacacaaaccacaaaggagaauggaagcacccgcgcucauaaagccacggucuacacaggcaccguggaguucaccccgaagcucgggagaauccagcuguuuacagacaccgauaaugaccuugaagccaaccagaauacaaaauucacgccuguuggagugauucaagauggcgaccaccagaacgaaccccagcaguggguccugcccuccuacucugggcggaauaaccacaaugugcaucucgcuccugccguugcgccgaccuuucccggagagcaacugcuguucuuucgcagcacaaugccuggcuguuccggcuaucccaacaugaaccucgauugccugcuuccucaggagugggugcaguacuucuaucaggaagcugcccccgcccaaagcgacgucgcucugcucagauuugugaauccugauaccgggcgggugcuguucgaguguaaacuucacaagucuggauacguuacagucgcccauaccggccaccacgaccuggugauucccccgaacggguauuuucgcuucgauuccugggugagcccuuuuuacacgcucgcucccaugggaaauggcaccgggagacggagauga

SEQ ID NO: 30464 - RNA, 1611 nt, Artificial Sequence
  derived and/or modified sequence opt5 from VP1__Norovirus_and/or_Norovirus-like__KF712507
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucaucgacccuuggaucagaaauaacuucgugcaggcccccggcggggaauuuacaguuuccccucggaaugcgcccggagaggugcuguggucugccccucuuggcccggaucugaaccccuaccucagccaccuggcucgcauguauaauggguacgccggaggcuucgaaguccaggugauucuugcuggcaacgccuuugcggccgggaaaaucauuuucgcugccguuccucccaauuuuuccacggagggacugucuccuagccaggugaccauguucccccaucucaucgucgacgugagacaacuggagccggugaugaucccucugcccgauauucggaacaauuuuuaucacuacaaccaguccaaugacccuacaaucaagcucauugcuaugcuguauacaccccuucgcgccaacaacgucggcgaugacguuuucaccgugagcugcagagugcugacccggcccucuccugauuuugacuucaucuuucucgucccgcccacaguggaauccaaaaccaauccuuucagcguucccauucugacgaucgaggaaaugaccaacucucgcuuuccuauuccccuugagaagcuguucacagggccguccagcgcccucgugguccagccucagaauggaagauguaccacagauggcgugcugcuggggaccacgcaacucucucccguuaacaucugcacauuccggggagacgugacccauacaaccaaaacccacacauaccagaugaaucuggcugcgcagaacuggaacuccuaugauccuacggaggaaauccccgccccucuuggcacccccgacuuugucggcaagauucagggggugcugacacaaaccacaaagggaaauggcagcacccgcgcucauaaagccacggucuacacagggaccguggaguucaccccgaagcucggaagaauccagcuguuuacagacaccgauaaugaccuugaagccaaccagaauacaaaauucacgccuguuggcgugauucaagauggggaccaccagaacgagccccagcaguggguccugcccuccuacucuggacggaauaaccacaaugugcaucucgcuccugccguugcgccgaccuuucccggcgaacaacugcuguucuuucgcagcacaaugccuggcuguuccggguaucccaacaugaaccucgauugccugcuuccucaggagugggugcaguacuucuaucaggaggcugcccccgcccaaagcgacgucgcucugcucagauuugugaauccugauaccggacgggugcuguucgaauguaaacuucacaagucuggcuacguuacagucgcccauaccgggcaccacgaccuggugauucccccgaacggauauuuucgcuucgauuccugggugagcccuuuuuacacgcucgcucccaugggcaaugggaccggcagacggagauga

SEQ ID NO: 30465 - RNA, 1611 nt, Artificial Sequence
  derived and/or modified sequence opt5 from VP1__Norovirus_and/or_Norovirus-like__JX401281
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccaugccucuuucuccggaacugaaucccuaccucagccaccugucccgcauguauaacggcuacgccgggggauucgagguccaggugauccuugcuggcaaugccuuuacagcuggcaaaauuaucuucgccgcgaucccucccaacuuuccuacggaugggcugucucccagccagguuaccauguucccgcauauuaucguggacgucagacaacucgagccugugcugauuccccugccugaugugcggaauaacuuuuaucacuacaaucaggccaacgacuccacacucaagcugaucgcuaugcuuuauacaccccugcgcgccaacaaugcuggagaugacgucuucaccguuagcugcagagugcucacccggcccucuccugauuuugacuucauuuuucuggugccgcccacagucgaaucccgcaccaaaccuuucacggugcccauccuuaccguugaugagaugacaaacagcagauuuccuacaccccuggaaaagcuccauaccggcccgaauaacucuauugugguccagccucagaaugggcgguguaccaucgacggagugcugcugggcacgacacaacucuccaccguuaacaucugcaauuuccgcgggagcacaaccagagccggacagucucacgccuacaccaugaaccuggugucccagaauuggaacaauuaugaucccacagaggagauuccugcuccccuuggcacgccugacuucgucggcaaaaucguggggaugcugagccagaccacacgggaaaacuccucuacccgcgcgcauaaggccacagucagcaccggagacgcucacuuuacgcccaaguccggcagcguucucuucacaaccgauaccgacgaucugcaaaaugggcagaacacaagauuuaccccggugggaguggcccaggacggcgagccucaccaaaaugaaccccagcaguggcggcuucccaacuacucugggacaccuggacauaacguccaccuggccccgcccguggcuccuacguuccccggcgagcagcuccuguuuuuccgcuccaccaugccuggcugugggggauaccccaauauggaucuggacugccuccugccucaagaauggguuagacauuuuuaucaggaggccgcgcccgcucagagcgauguggcccuucugcgguucgucaacccggacacaggcagagugcucuuugaguguaaacugcacaaggccggguacauuaccgugucucacacaggaccuuaugaucuuguuauucccccuaauggcuacuuccgcuuugacagcugggucaaccaguucuaugcucuggcccccauggggaccggcacgggacggagacgcuga

SEQ ID NO: 30466 - RNA, 1611 nt, Artificial Sequence
  derived and/or modified sequence opt5 from VP1__Norovirus_and/or_Norovirus-like__KF806526
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaaauucguucaggcccccggcggggaauuuaccguguccccucggaacgcgcccggagagauucuguggucugccccucuuggcccggaucugaaucccuaccucagccaccuggcucgcauguauaacggguacgccggaggcuucgaaguccaggugauccuugcuggcaaugccuuuacagcggggaagauuaucuucgccgcuguuccucccaacuuuccuacggagggacugucccccucucaggugaccauguucccgcauaucgucguggacgugagacaacucgagccuguccugauuccccugccugauguucggaauaacuuuuaucacuacaaucagagcaaagaccccacaaucaagcucauugccaugcuguauacaccccuucgcgcuaacaaugccggcgaagauguguucaccguguccugcagaguccugacccggccuagcccggacuuugauuucaucuuucucgugcccccuacaguugagucucgcuccaaacccuucaccgugccuauucugacggucgaagagaugaccaacagcagauuucccaucccgcuugagaagcuguucacagggccuucuggagccuucgugguucagccccagaacggccgguguaccacagacggggugcuccugggaaccacgcaacuguccccugucaauauuugcacauuucgcggcgaucucacccauuucgcuggcacacacgaauacgcgaugaaccuggccagccagaauuggaacaauuaugaccccaccgaggaaaucccugcuccccuuggggccccggauuuugugggaaagaucagaggcguccugacccagacaacgcggcgcgacgggucuaccagaggacaucgggccacacucuccaccggcagcgcucacuucacaccuaaacugggguccauucgcuuuucuaccgacacgaacaaugauuucgaggccggacagaacacaaaguuuacccccgugggcguuuuccaagacggcgauaaucaccagaacgaaccccagcaaugggugcuuccuaauuacagcggggcgaccgcucauaacguccaccuggccccggccguggcucccgccuuuccuggagagcagcuccuguucuuuagauccacaaugcccggcuguagcggguacccuaauaugaaccuggacugccuccugccccaggaguggguucagcauuucuaucaagaagcugccccugcgcagucugauguggcccuucugcgguuugucaaucccgacaccuccagaguucucuucgaguguaaacugcacaagagcggauacgugacaguggcucacacgggccagcaugaucuugucaucccgccuaacggguauuuccgcuuugacucuugggugaaccaguucuacacccuggcccccaugggcaauggaacaggccggagauga

SEQ ID NO: 30467 - RNA, 1611 nt, Artificial Sequence
  derived and/or modified sequence opt5 from VP1__Norovirus_and/or_Norovirus-like__KF806500
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaguuauuuucgccgcugugccucccaacuuuccuacggagggacugagccccucccaggucaccauguucccgcauaucaucguggacgugagacaacucgagccuguccugauuccccugccugauguucggaauaacuuuuaucacuacaaucagucuaacgacagcacaaucaagcucauugccaugcuguauacaccccuucgcgcuaacaaugccggcgaugacguguucaccguguccugcagaguccugacccggcccagcccugauuuugacuucaucuuucucgugccgcccacaguugaaucucgcaccaaaccuuucuccgugcccguccugacgguggaggaaaugaccaacagcagauuuccuauuccccuugagaagcuguucacagggccgucuuccgccuucguugugcagccucagaauggacgguguaccacagauggcguccuccuggggaccacgcaacugagcgcugugaacaucugcacauuucgcggagacgucacccauguggcgggcgauacauucgccaugaaucucgcuucucugaacuggaauaacuacgaccccaccgaggaaaccccugcuccccuuggcacaccugacuuuguugggagaauccacggaaugcugacgcagaccacacgguccgauggcgccacccgcgcccauaaagccacagugagcaccgggggagcggacuucacgcccaagcucggcuccgucagauauucuacagauaccagcuccgaccuggaggugcgggaaaauaccaaguuuacaccgaucgggguucuucacagcucuggaggccaccgcgcugagccugaucaguggagacugcccgaauacuccggccggaacgugcauaauguccaccucgcccccgccguggcuccuaccuucccgggggagcagcugcuguuuuucagaagcacaaugcccggauguggcggguacccuaacauggaccucgauugccugcuuccccaagagugggugcagcauuuuuaucaggaagccgcuccugcccaaucugacguugcgcugcuccgcuucgucaaucccgauacgggacgggugcuguuugaguguaaacuucacaagagcggcuacgugaccgucgcccacacagggccucaugaccuggugauucccccgaacggcuauuucagauuugauuccuggguuaaucaguucuacacccucgcuccuaugggaaacggcacagggcgccggagauga

SEQ ID NO: 30468 - RNA, 1611 nt, Artificial Sequence
  derived and/or modified sequence opt5 from VP1__Norovirus_and/or_Norovirus-like__KF806498
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaaggacagcacaauuaaacucaucgccaugcuguauacaccccuucgcgcuaacaacgccggcgaugacguuuucaccguguccugcagagugcugacccggcccagcccugauuuugacuucauuuuucucgucccgcccacaguggaaucucgcaccaagccuuucuccguucccgugcugacggucgaggaaaugaccaauagcagauuuccuaucccccuugagaaacuguucacagggccgucuuccgccuucgugguucagccucagaacggacgguguaccacagauggcgugcuccuggggaccacgcaacugagcgcugucaauauuugcacauuucgcggagacgugacccaugucgcgggcgauacauucgccaugaaccucgcuucucugaauuggaacaauuacgaccccaccgaggaaaccccugcuccccuuggcacaccugacuuuguggggagaauccacggaaugcugacgcagaccacacgguccgauggcgccacccgcgcccauaaggccacaguuagcaccgggggagcggacuucacgcccaagcucggcuccgugagauauucuacagauaccagcuccgaccuggagguccgggaaaacaccaaauuuacaccgaucggggugcuucacagcucuggaggccaccgcgcugagccugaucaguggagacugcccgaauacuccggccggaauguucauaacgugcaccucgcccccgccgucgcuccuaccuucccgggggagcagcugcuguuuuucagaagcacaaugcccggauguggcggguacccuaauauggaccucgauugccugcuuccccaagagugggugcagcauuuuuaucaggaagccgcuccugcccaaucugacguggcgcugcuccgcuucguuaaccccgauacgggacggguccuguuugaguguaaacuucacaagagcggcuacgugaccguggcccacacagggccucaugaccuggucauucccccgaauggcuauuucagauuugauuccugggugaaccaguucuacacccucgcuccuaugggaaauggcacagggcgccggagauga

SEQ ID NO: 30469 - RNA, 1611 nt, Artificial Sequence
  derived and/or modified sequence opt5 from VP1__Norovirus_and/or_Norovirus-like__KF429768
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucauugacccuuggaucagaaauaacuucgugcaggcccccggcggggaauuuacaguuuccccucggaaugcgcccggagaggugcuguggucugccccucuuggcccggaucugaaccccuaccucagccaccuggcucgcauguauaauggguacgccggaggcuucgaaguccaggugauucuugcuggcaacgccuuugcggccgggaaaaucauuuucgcugccguuccucccaauuuuuccacggagggacugucuccuagccaggugaccauguucccccaucucaucgucgacgugagacaacuggagccggugaugaucccucugcccgauauucggaacaauuuuuaucacuacaaccaguccaaugacccuacaaucaagcucauugcuaugcuguauacaccccuucgcgccaacaacgucggcgaugacguuuucaccgugagcugcagagugcugacccggcccucuccugauuuugacuucaucuuucucgucccgcccacaguggaauccaaaaccaauccuuucagcguucccauucugacgaucgaggaaaugaccaacucucgcuuuccuauuccccuugagaagcuguucacagggccguccagcgcccucgugguccagccucagaauggaagauguaccacagauggcgugcugcuggggaccacgcaacucucucccguuaacaucugcacauuccggggagacgugacccauacaaccaaaacccacacauaccagaugaaucuggcugcgcagaacuggaacuccuaugauccuacggaggaaacccccgccccucuuggcacacccgacuuugucggcaagauccagggggugcugacccaaacaaccaagggaaauggcagcacgcgcgcucauaaagccacagucuacaccgggaccguggaguucacaccgaagcucggacggauucagcuguuuaccgacacagauaaugaccuugaagccaaccagaauacgaaauucaccccuguuggcgugauccaagauggggaccaccagaacgagccccagcaguggguccugcccuccuacucuggaagaaauaaccacaaugugcaucucgcuccugccguugcgccgacauuucccggcgaacaacugcuguucuuucgcagcaccaugccuggcuguuccggguaucccaacaugaaccucgauugccugcuuccucaggagugggugcaguacuucuaucaggaggcugcccccgcccaaagcgacgucgcucugcucagauuugugaauccugauacaggacgggugcuguucgaauguaaacuucacaagucuggcuacguuaccgucgcccauacggggcaccacgaccuggugauucccccgaacggauauuuucgcuucgauuccugggugagcccuuuuuacacccucgcucccaugggcaaugggacaggcagacggagauga

SEQ ID NO: 30470 - RNA, 1611 nt, Artificial Sequence
  derived and/or modified sequence opt5 from VP1__Norovirus_and/or_Norovirus-like__KF806496
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaaggacagcacaauuaaacucaucgccaugcuguauacaccccuucgcgcuaacaacgccggcgaugacguuuucaccguguccugcagagugcugacccggcccagcccugauuuugacuucauuuuucucgucccgcccacaguggaaucucgcaccaagccuuucuccguucccgugcugacggucgaggaaaugaccaauagcagauuuccuaucccccuugagaaacuguucacagggccgucuuccgccuucgugguucagccucagaacggacgguguaccacagauggcgugcuccuggggaccacgcaacugagcgcugucaauauuugcacauuucgcggagacgugacccaugucgcgggcgauacauucgccaugaaccucgcuucucugaauuggaacaauuacgaccccaccgaggaaaccccugcuccccuuggcacaccugacuuuguggggagaauccacggaaugcugacgcagaccacacgguccgauggcgccacccgcgcccauaaggccacaguuagcaccgggggagcggacuucacgcccaagcucggcuccgugagauauucuacagauaccagcggggaccuggagguccgggaaaacaccaaauuuacaccgaucggagugcuucacuccagcggcgagcgcagagcugaaccugagcaguggcggcugcccgaguacucuggcagaaauguucacaacgugcaucucgcccccgccgucgcuccuaccuucccgggggaacagcugcuguuuuuccgcuccacaaugcccggauguggcggguacccuaauauggaucucgacugccugcuuccccaagagugggugcagcacuuuuaucaggaagccgcuccugcccaaagcgauguggcgcugcuccgguucguuaaccccgacacgggaagaguccuguuugaguguaaacuucauaagucuggcuacgugaccguggcccacacagggccucacgaucuggucauucccccgaauggcuauuuccgcuuugacagcugggugaaccaguucuacacccucgcuccuaugggaaauggcacagggcggagacgcuga

SEQ ID NO: 30471 - RNA, 1611 nt, Artificial Sequence
  derived and/or modified sequence opt5 from VP1__Norovirus_and/or_Norovirus-like__KF806499
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaaggacagcacaauuaaacucaucgccaugcuguauacaccccuucgcgcuaacaacgccggcgaugacguuuucaccguguccugcagagugcugacccggcccagcccugauuuugacuucauuuuucucgucccgcccacaguggaaucucgcaccaagccuuucuccguucccgugcugacggucgaggaaaugaccaauagcagauuuccuaucccccuugagaaacuguucacagggccgucuuccgccuucgugguucagccucagaacggacgguguaccacagauggcgugcuccuggggaccacgcaacugagcgcugucaauauuugcacauuucgcggagacgugacccaugucgcgggcgauacauucgccaugaaccucgcuucucugaauuggaacaauuacgaccccaccgaggaaaccccugcuccccuuggcacaccugacuuuguggggagaauccacggaaugcugacgcagaccacacgguccgauggcgccacccgcgcccauaaggccacaguuagcaccgggggagcggacuucacgcccaagcucggcuccgugagauauucuacagauaccagcuccgaccuggagguccgggaaaacaccaaauuuacaccgaucggggugcuucacagcucuggaggccaccgcgcugagccugaucaguggagacugcccgaauacuccggccggaauguucauaacgugcaccucgcccccgccgucgcuccuaccuucccgggggagcagcugcuguuuuucagaagcacaaugcccggauguggcggguacccuaauauggaccucgauugccugcuuccccaagagugggugcagcauuuuuaucaggaaacggccccugcucaaucugacguggcccugcuccgcuucguuaaccccgauaccggacggguccuguuugaguguaaacuucacaagagcggcuacgugacaguggcgcacaccgggccucaugaccuggucauucccccgaauggcuauuucagauuugauuccugggugaaccaguucuacacacucgccccuaugggaaauggcaccgggcgccggagauga

SEQ ID NO: 30472 - RNA, 1611 nt, Artificial Sequence
  derived and/or modified sequence opt5 from VP1__Norovirus_and/or_Norovirus-like__KF806497
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccauuuccccucggaaugcgcccggagagauccuguggucugccccucuuggcccggaucugaaccccuaccucagccaccuggcucgcauguauaauggguacgccggaggcuucgaagugcaggucgugcuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaggacuccacaauuaaacucaucgccaugcuguauacaccccuucgcgcuaauaacgccggcgaugacguuuucaccgugagcugcagagugcugacccggcccucuccugauuuugacuucauuuuucucgucccgcccacaguggaaucccgcaccaagccuuucagcguucccgugcugacggucgaggaaaugaccaacucuagauuuccuaucccccuugagaaacuguucacagggccguccagcgccuucgugguucagccucagaauggacgguguaccacagauggcgugcuccuggggaccacgcaacugucugcugucaacauuugcacauuucgcggagacgugacccaugucgcgggcgauacauucgccaugaaucucgcuucccugaacuggaauaacuacgaccccaccgaggaaaccccugcuccccuuggcacaccugacuuuguggggagaauccacggaaugcugacgcagaccacacggagcgauggcgccacccgcgcccauaaggccacaguuuccaccgggggagcggacuucacgcccaagcucggcucugugagauauagcacagauaccuccagcgaccuggagguccgggaaaauaccaaauuuacaccgaucggggugcuucacucuuccggaggccaccgcgcugagccugaucaguggagacugcccgaauacagcggccggaacguucauaaugugcaccucgcccccgccgucgcuccuaccuucccgggggagcagcugcuguuuuucagaucuacaaugcccggauguggcggguacccuaacauggaccucgauugccugcuuccccaagagugggugcagcauuuuuaucaggaagccgcuccugcccaaagcgacguggcgcugcuccgcuucguuaaucccgauacgggacggguccuguuugaguguaaacuucacaaguccggcuacgugaccguggcccacacagggccucaugaccuggucauucccccgaacggcuauuucagauuugauucuugggugaaucaguucuacacccucgcuccuaugggaaacggcacagggcgccggagauga

SEQ ID NO: 30473 - RNA, 1611 nt, Artificial Sequence
  derived and/or modified sequence opt5 from VP1__Norovirus_and/or_Norovirus-like__JN699046
augaugauggccagcaaggacgcuucccccucugccgauggcgcgaacggggcuggacagcuggugccugaggucaauaacgccgaaccgcucccccuggacccuguugccggcgcuagcaccgcccuugcuacagccgggcaagugaauaugaucgaucccuggaucuucaacaauuuugugcaggcgccucagggagaguucacgaucucccccaacaauaccccuggcgacauucuguuugaucuccagcuggggccgcaccuuaaccccuuccuggcccaucucucucaaauguacaauggaugggucggcaacaugagagugcggguuauccuggcuggcaaugccuuuacagcugggaaagugauuaucugcugugucccucccggauuccagagccgcacccuguccaucgcccaggcgacacucuuuccucacauuaucgccgacgugagaacccuggaacccauugagaucccgcuugaagauguucggaacacacuguaucauaccaaugacaaccagccuacgaugcgccuccugugcaugcuuuacacaccccugagaaccggcgggggaucuggcgggaccgaugcuuucguggucgccggacgggugcucacauguccuagcuccgacuuuaauuuccuguuucuggugccucccaccgucgagcaaaagacgcgccccuucagcguuccgaacauuccccuccagcugcuuucuaacuccagagugccuaaucugauccagagcauggugcucucucccgaucaggcucaaaacguccaguuucagaauggccggugcacaaccgacggccaacugcuugggacaaccccuguguccguuagccagauucugaaauuccgcggaaaggugucugccggcuccagagucaucaaccucaccgagcuggaugggagccccuuccuggccuuugaagcuccggcgccuacaggauuccccgaccucggcacguccgacuggcacguggagaugucucugaauagcaacucccagagcucugggaauccuauccuucugcgggauauucagcccaacuccagcgacuuuguuccucaucucggaucugugagcgucaccacagccaucgauguggcuggcgacuauaccggcacaauucaauggaccucccagcccucuaaugucacgccggugccugauguuaacuucuggacaaucccccaguacgggagcaaucuggccgaagccucccagcuugcucccguggucuauccuccgggauuuggcgaggccauuguguacuucaugagccccaucccugggcccaacaccgcgcacaaaccuaaucugguucccugucuccugccucaagaguuugugacccacuucgucucugaacaggcucccuccaugggagaggccgcccuggugcauuauguggacccggauacaaaccgcaaucucggcgaauuuaagcuguacccugagggguucauuaccugcguucccaacggcacaggaccucagcagcuuccccugaacggcgucuuuguguucgcuagcugggugucuagauuuuaccaacucaagccggucgggacggccuccagcgcucgguga

SEQ ID NO: 30474 - RNA, 1611 nt, Artificial Sequence
  derived and/or modified sequence opt5 from VP1__Norovirus_and/or_Norovirus-like__AM263418
augaugauggccagcaaggacgcuucccccucugccgauggcgcgaacggggcuggacagcuggugccugaggucaauaacgccgaaccgcucccccuggacccuguugccggcgcuagcaccgcccuugcuacagccgggcaagugaauaugaucgaucccuggaucuucaacaauuuugugcaggcgccucagggagaguucacgaucucccccaacaauaccccuggcgacauucuguuugaucuccagcuggggccgcaccuuaaccccuuccuggcccaucucucucaaauguacaauggaugggucggcaacaugagagugcggguuauccuggcuggcaaugccuuuacagcugggaaagugauugucugcugugugccucccggauuccagagccgcacccuguccaucgcccaggcgacacucuuuccucacaucauugccgacguuagaacccuggaacccaucgagauuccgcuugaagaugugcggaacacacuguaucauaccaaugacaaccagccuacgaugcgccuccugugcaugcuuuacacaccccugagaaccggcgggggaucuggcgggaccgaugcuuucgucguggccggacgggugcucacauguccuagcuccgacuuuaauuuccuguuucuggucccucccaccguugagcaaaagacgcgccccuucagcgugccgaacaucccccuccagcugcuuucuaacuccagagugccuaaucugauucagagcaugguccucucucccgaucaggcucaaaacgugcaguuucagaauggccggugcacaaccgacggccaacugcuugggacaaccccuguuuccgugagccagauccugaaauuccgcggaaaggucucugccggcuccagagugauuaaccucaccgagcuggaugggagccccuuccuggccuuugaagcuccggcgccuacaggauuccccgaccucggcacguccgacuggcacguugagaugucucugaauagcaacucccagagcucugggaauccuauccuucugcgggauauccagcccaacuccagcgacuuugugccucaucucggaucugucgccgugaccacagcuauugaugucgccggcgacuauaccggcacaauccaauggaccagccagcccuccaaugugacgccgguuccugaugugaacuucuggacaauuccccaguacgggucuaaucuggccgaagcuagccagcuugcccccgucguguauccuccgggauuuggcgaggcgaucguuuacuucaugucccccauuccugggcccaacaccgcucacaaaccuaaucuggugcccugucuccugccucaagaguuugucacccacuucgugagcgaacaggcccccucuaugggagaggccgcucuggugcauuauguugacccggauacaaaccgcaaucucggcgaauuuaagcuguacccugagggguucauuaccugcguccccaacggcacaggaccucagcagcuuccccugaacggcguguuuguguucgccuccugggucagcagauuuuaccaacucaagccgguggggacggcuucuuccgcccgguga

SEQ ID NO: 30475 - RNA, 1611 nt, Artificial Sequence
  derived and/or modified sequence opt5 from VP1__Norovirus_and/or_Norovirus-like__KT732278
augaugauggccagcaaggacgcuacccccuccgccgauggcgcgaacggggcuggacagcuggugccugaggucaauaacgccgaaccgcucccccuggacccuguugccggcgcuucuacagcccuugcuacggccgggcaagugaauaugaucgaucccuggauuuucaacaauuuugugcaggcgccucagggagaguucaccaucagccccaacaauacaccuggcgacauucuguuugaucuccagcuggggccgcaccuuaaccccuuccuggcccaucucucccaaauguacaauggaugggucggcaacaugagagugcggguuauccuggcuggcaaugccuuuaccgcugggaaagugauuaucugcugugucccucccggauuccagucucgcacacugagcaucgcccaggcgacccucuuuccucacauuaucgccgacgugagaacacuggaacccauugagaucccgcuugaagauguucggaacacccuguaucauacgaaugacaaccagccuaccaugcgccuccugugcaugcuuuacacaccccugagaaccggcgggggauccggcgggacagaugcuuucguggucgccggacgggugcucaccucuccuagccccgacuuuaauuuccuguuucuggugcccccuacggucgagcaaaagacacgcccguucuccguucccaacauuccucuccagcugcuuagcaacucuagagugcccaaucugauccaguccauggugcucagcccugaucaggcucaaaacguccaguuucagaauggccgguguaccacagacggccaacugcuugggaccacccccgugucuguuucccagauucugaaauuccgcggaaaggugagcgccggcucuaaagucaucaaccucacagagcuggauggguccccguuccuggccuuugaagcuccugcgcccacgggauucccugaccucggcaccagcgacuggcacaucgagaugucccuuaauucuaacagccaguccagcgggaaucccauucugcugagagauauccagccuaacucuuccgacuuugugccccaucucggaagcguugccgugacaaccgcuauugauacagccggcgacuauaccggcacgauccaauggacaucucagccgagcaaugucaccccugugcccgaugucaacuucuggaccauuccccaguacggguccaaucuggccgaggcuucucagcuugccccugugguuuauccgcccggauuuggcgaagcgaucguguacuucaugagcccuauccccgggccuaacacagcucacaagcccaaucuggucccuugccuccugccccaagaguuugugacccacuucguuuccgaacaggccccgagcaugggagaggccgcucuggugcauuaugucgacccugauacaaaccggaaucucggcgaauuuaagcuguaccccgagggguucauuacgugugugccuaacggcaccggaccccagcagcuuccgcugaacggcguguuuguuuucgccucuugggucucccgcuuuuaccaacucaaaccuguggggacagcuaauagcgccagauga

SEQ ID NO: 30476 - RNA, 1611 nt, Artificial Sequence
  derived and/or modified sequence opt5 from VP1__Norovirus_and/or_Norovirus-like__KT732277
augaugauggccagcaaggacgcuacccccuccgccgauggcgcgaacggggcuggacagcuggugccugaggucaauaacgccgaaccgcucccccuggacccuguugccggcgcuucuacagcccuugcuacggccgggcaagugaauaugaucgaucccuggauuuucaacaauuuugugcaggcgccucagggagaguucaccaucagccccaacaauacaccuggcgacauucuguuugaucuccagcuggggccgcaccuuaaccccuuccuggcccaucucucccaaauguacaauggaugggucggcaacaugagagugcggguuauccuggcuggcaaugccuuuaccgcugggaaagugauuaucugcugugucccucccggauuccagucucgcacacugagcaucgcccaggcgacccucuuuccucacauuaucgccgacgugagaacacuggaacccauugagaucccgcuugaagauguucggaacacccuguaucauacgaaugacaaccagccuaccaugcgccuccugugcaugcuuuacacaccccugagaaccggcgggggauccggcgggacagaugcuuucguggucgccggacgggugcucaccucuccuagccccgacuuuaauuuccuguuucuggugcccccuacggucgagcaaaagacacgcccguucuccguucccaacauuccucuccagcugcuuagcaacucuagagugcccaaucugauccaguccauggugccuagccccgaucaggcucaaaacguccaguuucagaauggccgguguaccacagacggccaacuccuggggaccaccccggugucuguuucccagauucuuaaauuccgcggaaaggugagcgccggcucuaaagucaucaaccugacagagcucgauggguccccuuuccuggccuuugaagcucccgcgccuacgggauuccccgaccugggcaccagcgacuggcacaucgagaugucccucaauucuaacagccaguccagcgggaauccuauucugcuuagagauauccagcccaacucuuccgacuuugugccgcaucugggaagcguugccgugacaaccgcuauugauacagccggcgacuauaccggcacgauccaauggacaucucagccuagcaaugucacccccgugcccgaugucaacuucuggaccauuccucaguacggguccaaucucgccgaggcuucucagcuggccccggugguuuaucccccuggauuuggcgaagcgaucguguacuucaugagccccaucccugggcccaacacagcucacaagccuaaucuuguccccugccugcucccgcaagaguuugugacccacuucguuuccgaacaggccccuagcaugggagaggccgcucuggugcauuaugucgaccccgauacaaaccggaaucugggcgaauuuaagcucuacccugagggguucauuacgugugugcccaacggcaccggaccgcagcagcugccucuuaacggcguguuuguuuucgccucuugggucucccgcuuuuaccaacugaaacccguggggacagcuaauagcgccagauga

SEQ ID NO: 30477 - RNA, 1611 nt, Artificial Sequence
  derived and/or modified sequence opt5 from VP1__Norovirus_and/or_Norovirus-like__KJ402295
augaugauggccagcaaggacgcucccuccucugccgauggcgcgaacggggcuggacagcuggugccugaggucaauaacgccgaaccgcucccccuggacccuguugccggcgcuagcaccgcccuugcuacagccgggcaagugaauaugaucgaucccuggauuuucaacaauuuugugcaggcgccucagggagaguucacgaucucccccaacaauaccccuggcgacauucuguuugaucuccagcuggggccgcaccuuaaccccuuccuggcccaucucucucaaauguacaauggaugggucggcaacaugagagugcggguuauccuggcuggcaaugccuuuacagcugggaaagugauuaucugcugugucccucccggauuccagagccgcacccuguccaucgcccaggcgacacucuuuccucacauuaucgccgacgugagaacccuggaacccauugagaucccgcuugaagauguucggaacacacuguaucauaccaaugacaaccagccuacgaugcgccuccugugcaugcuuuacacaccccugagaaccggcgggggaucuggcgggaccgaugcuuucguggucgccggacgggugcucacauguccuagcuccgacuuuaauuuccuguuucuggugccucccaccgucgagcaaaagacgcgccccuucagcguuccgaacauuccccuccagcugcuuucuaacuccagagugccuaaucugauccagagcauggugcucucucccgaucaggcucaaaacguccaguuucagaauggccggugcacaaccgacggccaacugcuugggacaaccccuguguccguuagccagauucugaaauuccgcggaaaggugucugccggcuccaaagucaucaaccucaccgagcuggaugggagccccuuccuggccuuugaagcuccggcgccuacaggauuccccgaccucggcacguccgacuggcacguggagaugucucugaauagcaacucccagagcucugggaauccuauccuucugagagauauucaucccaacuccagcgaauuuguuccucaccucggaucugugugugucaccgccgcuaucgagguggccggcgacuauacaggcaccauucaguggacaagccaacccuccaaugucaccccggugccugauguuaacuucuggacgaucccccacuacgggucuaaucuggccgaggcuagccagcuugcccccguggucuauccuccgggauuuggcgaagcgauuguguacuucaugucccccaucccugggcccaacacagcucauaagccuaaucugguucccugccuccugccucaggaguuugugacccacuucgucagcgaacaggcccccucuaugggagaggccgcucuggugcauuauguggacccggauaccaaccggaaucucggcgaauuuaagcuguacccugagggguucaucacauguguucccaacggcaccggaccucaacagcuuccccugaacggcgucuuuguguucgccuccugggugagccgcuuuuaccagcucaaaccggucgggacagcuucuuccgccagauga

SEQ ID NO: 30478 - RNA, 1611 nt, Artificial Sequence
  derived and/or modified sequence opt5 from VP1__Norovirus_and/or_Norovirus-like__AF414406
augaugauggccagcaaggacgcuucccccucugccgauggcgcgaacggggcuggacagcuggugccugaggucaauaacgccgaaccgcucccccuggacccuguugccggcgcuagcaccgcccuugcuacagccgggcaagugaauaugaucgaucccuggauuuucaacaauuuugugcaggcgccucagggagaguucacgaucucccccaacaauaccccuggcgacauucuguuugaucuccagcuggggccgcaccuuaaccccuuccuggcccaucucucucaaauguacaauggaugggucggcaacaugagagugcggguuauccuggcuggcaaugccuuuacagcugggaaagugauugucugcugugugccucccggauuccagagccgcacccuguccaucgcccaggcgacacucuuuccucacaucauugccgacguuagaacccuggaacccaucgagauuccgcuugaagaugugcggaacacacuguaucauaccaaugacaaccagccuacgaugcgccuccugugcaugcuuuacacaccccugagaaccggcgggggaucuggcgggaccgaugcuuucgucguggccggacgggugcucacauguccuagcuccgacuuuaauuuccuguuucuggucccucccaccguugagcaaaagacgcgccccuucagcgugccgaacaucccccuccagcugcuuucuaacuccagagugccuaaucugauucagagcaugguccccucuccugaucaggcucaaaacgugcaguuucagaauggccggugcacaaccgacggccaacuccuggggacaacccccguuuccgugagccagauccuuaaauuccgcggaaaggucucugccggcuccagagugauuaaccugaccgagcucgaugggagcccguuccuggccuuugaagcuccugcgcccacaggauucccugaccugggcacguccgacuggcacguugagaugucucucaauagcaacucccagagcucugggaaucccauccugcuucgggauauccagccuaacuccagcgacuuugugccccaucugggaucugucgccgugaccacagcuauugaugucgccggcgacuauaccggcacaauccaauggaccagccagccguccaaugugacgccuguucccgaugugaacuucuggacaauuccccaguacgggucuaaucucgccgaagcuagccagcuggccccugucguguauccgcccggauuuggcgaggcgaucguuuacuucauguccccuauucccgggccuaacaccgcucacaaacccaaucuugugccucgccugcucccccaagaguuugucacccacuucgugagcgaacaggccccgucuaugggagaggccgcucuggugcauuauguugacccugauacaaacagaaaucugggcgaauuuaagcucuaccccgagggguucgucaccuguaugccuaacggcacaggaccccagcagcugccgcuuaacggcguguuuguguucgccuccugggucagccgguuuuaccaacugaagccuguggggacggcuucuuccgcccgcuga

SEQ ID NO: 30479 - RNA, 1611 nt, Artificial Sequence
  derived and/or modified sequence opt5 from VP1__Norovirus_and/or_Norovirus-like__AB039774
augaugauggccagcaaggacgcuacccccuccgccgauggcgcgaacggggcuggacagcuggugccugaggucaauaacgccgaaccgcucccccuggacccuguugccggcgcuucuacagcccuugcuacggccgggcaagugaauaugaucgaucccuggauuuucaacaauuuugugcaggcgccucagggagaguucaccaucagccccaacaauacaccuggcgacauucuguuugaucuccagcuggggccgcaccuuaaccccuuccuggcccaucucucccaaauguacaauggaugggucggcaacaugagagugcggguuauccuggcuggcaaugccuuuaccgcugggaaagugauuaucugcugugucccucccggauuccagucucgcacacugagcaucgcccaggcgacccucuuuccucacgugauugccgacguuagaacacuggaaccccuugagaucccgcuggaagaugugcggaacacccucuaucauaauaacgacucccagccuacgaugcgccugcuuugcaugcuguacacaccccucagaaccggcgggggaucuggcgggaccgaugcuuucgucguggccggacgggugcugacauguccuagccccgacuuuaauuuccuguuucucguucccccuaccgucgagcaaaagacgcgcccguucuccgugcccaacauuccucugcagaaccuuagcaauucuagagugcccucccugauccagagcaugguccucucuaacgaucacgcucagacagugcaauuucagaauggccggugcaccacagacggccaucugcuugggaccaccccuguuuccgccggacagcugaugaaauuccgcggcaaggugacaagcgggucuaaaguccucaaccugacggagcuggauggaucccccuuccucgccuuugaagcuccggcgccugccggcuuccccgaccuggggaagugugacuggcacguggagaugagccuuuaucaagauaauaaccacgcugacccuauuguucugcaugccaucgaacccaauuccucuagcuuugugccucaccucggauccgucagcuucaaggagaacgugaaugucgccggcgauuacgugugcaccauucaguauacaucucccccguccgacccucauaaccccaaugcugauguugacuuuuggagcauccccgauuacggcucuaaccuggccgaggcgagccagcuugcuccuguggucuauccgcccggguucggagaagccaucguguacuuuauguccagaguuccuggcuggaaucggaccaaccgccugaaucucgugcccugucugcugccucaggaguucauugggcacuuugucucugaacaagcccccgcuaucggagaggccgcucuccugcacuacguggacccugauacaaacagaaaccuuggcgaguucaaacuguaucccgaaggguuuauuaccugcgugccgaauggcacgggaccucagcagcucccccugaacggcguuuucgucuuuagcuccugggugagccgguucuaccagcugaagccuguggggacagccucucuugcgcgcuga

SEQ ID NO: 30480 - RNA, 1611 nt, Artificial Sequence
  derived and/or modified sequence opt5 from VP1__Norovirus_and/or_Norovirus-like__KP064095
auggccagcaaggacgcuccccaguccgccgauggcgcgucuggggcuggacaacuggugccugaggucaacaccgccgacccgcuccccauggaaccuguugccggccccacaacggcuguggccaccgcuggacaggugaauaugaucgauccuuggauugucaacaauuucgugcagagcccccagggggaguuuacaaucuccccuaacaauaccccgggcgacauucuguucgaucuucaacuggggccccaccucaacccuuuucugucucaucuuagccagauguacaauggauggguuggcaacaugagagugcggauccugcucgccggcaaugcguucuccgccgggaaaauuaucgucugcugugugcccccuggauuuacaucuagcucccugaccaucgcucaggccacacuguucccccacguuauugcugacgugcgcacccucgaaccgaucgagaugccucuggaagaugucagaaacgugcuuuaucauacgaaugacaaccagcccaccaugcggcuggugugcaugcucuacacaccucugcgcaccggcgggggaagcggcaauucugauuccuuugucguugccgggagagugcuuacagcgcccagcucugacuucuccuuucuguuccucgugcccccuaccauugagcaaaagacgcgggccuuuacagucccgaacaucccccugcagacccugagcaauucucgcuucccuucccucauucagggaaugauccugagccccgaugcuucccaggugguucaauuucagaacggcagaugucuuauugacggccagcugcucgggacaaccccugccaccucuggacaacuguuccgggugcgcggcaaaaucaaccagggggcuagaacacuuaaucugacggaggucgauggaaagcccuucauggccuuugacagcccggccccugugggcuuccccgacuuugggaaaugcgauuggcacaugcggaucuccaagaccccuaacaauacaagcucuggagaccccaugcgcuccguuagcgugcagaccaacguccagggcuucgugccucaucucggcucuauucaauuugaugaagucuucaaucaccccacaggggacuauaucggaaccauugaguggaucagccagccguccacgccucccggcacagauauuaaccugugggaaauccccgacuacgggucuagccugucccaggcugcgaaucucgccccuccgguguuucccccuggauucggcgaggcucugguuuauuuugugagcgccuuccccgggccuaacaauagaucugcccccaacgaugucccuugucuucugccccaggaguacaucacccacuuuguguccgaacaagcuccgaccaugggcgacgccgcgcuccugcauuauguugauccugacacaaaucggaaccuuggagaguucaagcuguaccccggcggguaccugaccugcgugccuaauggagucggcgcugggccccagcagcucccgcugaacggaguguuucucuucgugagcuggguuucucgcuucuaucagcugaaaccugucggcacagccuccacggccagauga

SEQ ID NO: 30481 - RNA, 1608 nt, Artificial Sequence
  derived and/or modified sequence opt5 from VP1__Norovirus_and/or_Norovirus-like__AB045603
augaagauggccagcuccgacgcugcccccucuaacgauggcgcggcugggcuggugccugaggccaauaacgaaaccauggcccucgagccggucgcuggagccagcaucgcugcgccccugacaggccagaauaacauuaucgacccuuggauuagacuuaauuucguucaagcccccaacggggaauuuacgguguccccucgcaauucucccggagaggugcugcucaaccuggaacuuggcccugagcugaauccguaccucgcccaccugagccggauguauaacggguacgcuggaggcgucgaggugcagguucugcucgccggcaaugcuuucaccgccgggaaacugguguuugcggccgugcccccucauuucccccuugaaaacaucuccccuggacagauuacaauguuuccccacgugaucaucgauguuagaacccuggagccggugcuccugccucuucccgacguccggaauaacuucuuucauuauaaucagcaaaacgaaccucgcaugagacugguggcuaugcucuacacaccccugcggucuaacggcagcggggaugacguguucaccgucuccugccgcguucugacaagacccagcccugauuuugacuucaauuaucucgugccgcccaccguggagucuaagacgaaaccuuuuacccugcccauucuuacaaucggagagcugaccaacucccgguucccuguccccauugaugaacucuacacaagcccgaaugagucucuggugguucagccucagaacggccgcugugcccuugacggggaacugcagggaaccacgcaacuccugcccacagcuaucugcuccuuuagaggccggauuaaucagaaggugagcggcgagaaccacgucuggaauaugcaggucaccaacaucaaugggacaccuuucgaucccaccgaagacguuccugcuccccugggaaccccggauuucucuggcaaacucuuuggggugcugucccagcgcgaccaugacaacgccuguagaagccacgaugccgucauugcgacaaauuccgccaaguucacgccuaaacuuggagcuauccaaaucggcaccugggaggaggacgaugugcacauuaaccagcccacaaaguuuacccccgucgggcuguucgaaaaugagggauuuaaccaguggacacucccuaauuauucuggcgcccugacccuuaacaugggccuggccccgcccguggcuccuacguuccccggggaacaaauccucuuuuuccggagccauauuccucugaagggaggcguugccgaccccgugaucgauugccugcucccucaggaguggauucagcaccuguaccaggaauccgcgcccagccaaucugacgucgcucuuauccgcuuuacaaacccggauaccgggagagugcuguucgaggccaaacuccaucgguccggauacaucaccguugccaauacaggcagcagaccuauugugguccccgcuaacggguauuuucgcuucgacucuugggugaaucaguuuuacagccuggccccuaugggcaccggaaacggccggagacgcgugcaguga

SEQ ID NO: 30482 - RNA, 1608 nt, Artificial Sequence
  derived and/or modified sequence opt5 from VP1__Norovirus_and/or_Norovirus-like__AF397905
augaagauggccagcuccgacgcugcccccucuaacgauggcgcggcugggcuggugccugaggccaauaacgaaaccauggcccucgagccggucgcuggagccagcaucgcugcgccccugacaggccagaauaacauuaucgacccuuggauuagacuuaauuucguucaagcccccaacggggaauuuacgguguccccucgcaauucucccggagaggugcugcucaaccuggaacuuggcccugagcugaauccguaccucgcccaccugagccggauguauaacggguacgcuggaggcgucgaggugcagguucugcucgccggcaaugcuuucaccgccgggaaacugguguuugcggccgugcccccucauuucccccuugaaaacaucuccccuggacagauuacaauguuuccccacgugaucaucgauguuagaacccuggagccggugcuccugccucuucccgacguccggaauaacuucuuucauuauaaucagcaaaacgaaccucgcaugagacugguggcuaugcucuacacaccccugcggucuaacggcagcggggaugacguguucaccgucuccugccgcguucugacaagacccagcccugauuuugacuucaauuaucucgugccgcccaccguggagucuaagacgaaaccuuuuacccugcccauucuuacaaucggagagcugaccaacucccgguucccuguccccauugaugaacucuacacaagcccgaaugagucucuggugguucagccucagaacggccgcugugcccuugacggggaacugcagggaaccacgcaacuccugcccacagcuaucugcuccuuuagaggccggauuaaucagaaggugagcggcgagaaccacgucuggaauaugcaggucaccaacaucaaugggacaccuuucgaucccaccgaagacguuccugcuccccugggaaccccggauuucucuggcaaacucuuuggggugcugucccagcgcgaccaugacaacgccuguagaagccacgaugccgucauugcgacaaauuccgccaaguucacgccuaaacuuggagcuauccaaaucggcaccugggagcaggacgaugugcacauuaaccagcccacaaaguuuacccccgucgggcuguucgagaaugaaggauuuaaccaauggacacucccuaauuauucuggcgcccugacccuuaacaugggccuggccccgcccguggcuccuacguuccccggggagcagauccucuuuuuccggagccauauuccucugaagggaggcguugccgaccccgugaucgauugccugcucccucaggaauggauucagcaccuguaccaagaguccgcgcccagccagucugacgucgcucuuauccgcuuuacaaacccggauaccgggagagugcuguucgaagccaaacuccaucgguccggauacaucaccguugccaauacaggcagcagaccuauugugguccccgcuaacggguauuuucgcuucgacucuugggugaaucaguuuuacagccuggccccuaugggcaccggaaacggccggagacgcgugcaguga

SEQ ID NO: 30483 - RNA, 1608 nt, Artificial Sequence
  derived and/or modified sequence opt5 from VP1__Norovirus_and/or_Norovirus-like__AF414420
augaagauggccagcuccgacgcugcccccucuaacgauggcgcggcugggcuggugccugaggccaauaacgaaaccauggcccucgagccggucgcuggagccagcaucgcugcgccccugacaggccagaauaacauuaucgacccuuggauuagacuuaauuucguucaagcccccaacggggaauuuacgguguccccucgcaauucucccggagaggugcugcucaaccuggaacuuggcccugagcugaauccguaccucgcccaccugagccggauguauaacggguacgcuggaggcgucgaggugcagguucugcucgccggcaaugcuuucaccgccgggaaacugguguuugcggccgugcccccucauuucccccuugaaaacaucuccccuggacagauugcuauguuuccccacgucaucaucgauguuagaacacuggagccggugcuccugccucuucccgacguccggaauaacuucuuucauuauaaucagcaaaacgaaccucgcaugagacugguggccaugcucuacacaccccugcggucuaacggcagcggggaugacguguucaccgucuccugccgcguucugaccagacccagcccugauuuugacuucaauuaucucgugccgcccacaguggagucuaagaccaaaccuuuuacgcugcccauucuuaccaucggagagcugacaaacucccgguucccuguccccauugaugaacucuacaccagcccgaaugagucucuggugguucagccucagaacggccgcugugugcuugacggggaacugcagggaacaacccaacuccugcccacggcuaucugcuccuuuagaggccggauuaaucagaaggucagcggcgagaaccacguguggaauaugcagguuacaaacaucaaugggaccccuuucgaucccacagaagacgugccugcuccccugggaaccccggauuucucuggcaaacucuuugggguccugucccagcgcgaccaugacaacgccuguagaagccacgaugccgugauugcgaccaauuccgccaaguucacaccuaaacuuggagcuauccaaaucggcacgugggaggaggacgauguccacauuaaccagcccaccaaguuuacacccguggggcuguucgaaaaugagggauuuaaccaguggacccucccuaauuauucuggcgcccugacacuuaacaugggccuggccccgcccguugcuccuaccuuccccggggaacaaauccucuuuuuccggagccauauuccucugaagggaggcguggccgaccccgucaucgauugccugcucccucaggaguggauucagcaccuguaccaggaauccgcgcccagccaaucugacguggcucuuauccgcuuuacgaacccggauacagggagaguucuguucgaggccaaacuccaucgguccggauacaucaccguggccaauaccggcagcagaccuauugucgugcccgcuaacggguauuuucgcuucgacucuugggugaaucaguuuuacagccuggccccuaugggcacaggaaacggccggagacgcguucaguga

SEQ ID NO: 30484 - RNA, 1608 nt, Artificial Sequence
  derived and/or modified sequence opt5 from VP1__Norovirus_and/or_Norovirus-like__AF427119
augaagauggccagcuccgacgcugcccccucuaacgauggcgcggcugggcuggugccugaggccaauaacgaaaccauggcccucgagccggucgcuggagccagcaucgcugcgccccugacaggccagaauaacguuauugacccuuggaucagacuuaauuucgugcaagcccccaacggggaauuuacgguguccccucgcaauucucccggagagauucugcucaaccuggaacuuggcccugagcugaauccguaccucgcccaccugagccggauguauaacggguacgcuggaggcgucgaggugcagguucugcucgccggcaaugcuuucaccgccgggaaacugguguuugcggccgugcccccucauuucccccuugaaaacaucuccccuggacagauuacaauguuuccccacgugaucaucgauguuagaacccuggagccggugcuccugccucuucccgacguccgcaauucuuucuuucauuauaaccagcaaaaugaaccucggaugagacugguggcuaugcucuacacaccccugcggagcaacggcuccggggaugacguguucaccgucagcugccgcguucugacaagacccucuccugauuuugacuucaacuaucucgugccgcccaccguggaguccaagacgaaaccuuuuacccugcccauucuuacaaucggagagcugaccaauagccgguucccugcccccauugaugaacucuacacaucuccgaacgagucccuggucgugcagccucagaauggccgcugugcucuugacggggaacugcagggaaccacgcaacuccugcccacagccaucugcagcuuuagaggccggauuaaccagaagguuucuggcgagaaucacaucuggaacaugcaggucaccaauacaaacgggaccccuuucgaucccaccgaagacgucccugcuccccugggaacaccggauuucuccggccgccucuuuggggugcugagccagagagaccaugacaaugccugucggucccacgaugcgguuauugccacgaacucugcuaaauucaccccuaaacuuggagccauccaaaucggcacaugggaggaggacgaugugcacauuaaucagcccaccaaguuuacacccgucgggcuguucgaacauggagacuuuaaccaguggacccucccuaauuauagcggcgcccugacgcuuaacaugggccuggcuccgcccguggccccuacauuccccggggagcaaauccucuuuuuccgcucccacauuccucugaagggaggcgucgcggaucccgugaucgacugccugcucccucaggaauggauucagcaucuguaccaggagagcgcucccucucaauccgauguugcccuuaucagauuuaccaauccggacaccgggcgggugcuguucgaagccaagcuccacagaagcggauacaucacagucgcuaacaccggcucucgcccuauugugguucccgccaacggguauuuucgguucgauagcugggugaaucaguuuuacucccuggcuccuaugggcacaggaaacggcagacgccggguccaguga

SEQ ID NO: 30485 - RNA, 1608 nt, Artificial Sequence
  derived and/or modified sequence opt5 from VP1__Norovirus_and/or_Norovirus-like__AB044366
augaagauggccagcuccgacgcugcccccucuaacgauggcgcggcugggcuggugccugaggccaauaacgaaaccauggcccucgagccggucgcuggagccagcaucgcugcgccccugacaggccagaauaacauuaucgacccuuggauuagacuuaauuucguucaagcccccaacggggaauuuacgguguccccucgcaauucucccggagaggugcugcucaaccuggaacuuggcccugagcugaauccguaccucgcccaccugagccggauguauaacggguacgcuggaggcgucgaggugcagguucugcucgccggcaaugcuuucaccgccgggaaacugguguuugcggccgugcccccucauuucccccuugaaaacaucuccccuggacagauuacaauguuuccccacgugaucaucgauguuagaacccuggagccggugcuccugccucuucccgacguccggaauaacuucuuucauuauaaucagcaaaacgaaccucgcaugagacugguggcuaugcucuacacaccccugcggucuaacggcagcggggaugacguguucaccgucuccugccgcguucugacaagacccagcccugauuuugacuucaauuaucucgugccgcccaccguggagucuaagacgaaaccuuuuacccugcccauucuuacaaucggagagcugaccaacucccgguucccuguccccauugaugaacucuacacaagcccgaaugagucucuggugguucagccucagaacggccgcugugcccuugacggggaacugcagggaaccacgcaacuccugcccacagcuaucugcuccuuuagaggccggauuaaucagaaggugagcggcgagaaccacgucuggaauaugcaggucaccaacaucaaugggacaccuuucgaucccaccgaagacguuccugcuccccugggaaccccggauuucucuggcaaacucuuuggggugcugucccagcgcgaccaugacaacgccuguagaagccacgaugccgucauugcgacaaauuccgccaaguucacgccuaaacuuggagcuauccaaaucggcaccugggaggaggacgaugugcacauuaaccagcccacaaaguuuacccccgucgggcuguucgaagacggaggcuuuaaucaguggacacucccuaacuauucuggcgcccugacccuuaauauggggcuggccccgcccguggcuccuacguuccccggagagcaaauccucuuuuuccggagccauauuccucugaagggcgggguugccgaucccgugaucgacugccugcucccucaggaauggauucagcaccuguaccaggaguccgcgcccagccaaucugaugucgcucuuauccgcuuuacaaacccggacaccggaagagugcuguucgaagccaaacuccaucgguccggcuacaucaccguugccaacacagggagcagaccuauugugguccccgcuaauggcuauuuucgcuucgauucuugggugaaccaguuuuacagccuggccccuaugggaaccggcaaugggcggagacgcgugcaguga

SEQ ID NO: 30486 - RNA, 1608 nt, Artificial Sequence
  derived and/or modified sequence opt5 from VP1__Norovirus_and/or_Norovirus-like__AB032758
augaagauggccagcaacgacgcugcccccuccaaugauggcgcggcugggcuggugccugaggccaacaaugaaaccauggcccucgagccggucgcuggagccucuaucgcugcgccccugacaggccagaacaauauuaucgacccuuggauuagacuuaacuucguucaagcccccaauggggaauuuacggugagcccucggaacucccccggagaggugcugcucaaucuggaacuuggcccugagcugaacccguaccucgcccaccugucucgcauguauaauggguacgcuggaggcgucgaggugcagguucugcucgccggcaacgcuuucaccgccgggaaacugguguuugcggccgugcccccucauuucccccuugaaaauaucagcccuggacagauuacaauguuuccccacgucaucaucgauguuagaacccuggagccggugcuccugccucuucccgacguccggaacaauuucuuucauuauaaccagcaaaacgaaccucgcaugagacugguggcuaugcucuacacaccccugcgguccaauggcucuggggaugacguguucaccgucagcugccgcguucugacaagacccuccccugauuuugacuucaacuaucucgugccgcccacccuggagagcaagacgaaaccuuuuacccuucccauucugacaaucggagagcucaccaauucucgguucccugugcccauugaugaacuguacacauccccgaacgagagccuugucgugcagccucagaauggccgcugugcccuggacggggaacuccagggaaccacgcaacugcugcccacagcuaucugcucuuuuagaggccggauuaaccagaagguuuccggcgagaaucacguguggaacaugcaggucaccaauaucaacgggacaccuuucgaucccaccggagacgugccugcuccccucggcaccccggauuucagcgggaaacuguuuggaguucuuucucagcgcgaccaugacaaugccuguagaucccacgaugccgugauugcgacaaacagcgccaaguucacgccuaagcugggcgcuauccaaaucgggaccugggaagaggacgauguccacauuaaucagcccacaaaauuuacccccgugggacucuucgagaacgaaggcuuuaaucaguggacacugccuaacuauuccggcgcccuuacccugaacauggggcucgccccgcccgucgcuccuacguuccccggagagcaaauccuguuuuuccggucucauauuccucugaagggcgggguggccgaccccguuaucgauugccuccugccucaggaauggauucagcaccuuuaccaggagagcgcgcccucccaaagcgacguggcucugauccgcuuuacaaauccggauaccggaagaguccucuucgaagccaaacugcaucggucuggcuacaucaccguggccaacacaggguccagaccuauuguugugcccgcuaauggcuauuuucgcuucgacaccugggucaaccaguuuuacagccuggccccuaugggaacaggcaaugggcggagacgcgugcaguga

SEQ ID NO: 30487 - RNA, 1608 nt, Artificial Sequence
  derived and/or modified sequence opt5 from VP1__Norovirus_and/or_Norovirus-like__AB039775
augaagauggccagcuccgacgcugcccccucuaacgauggcgcggcugggcuggugccugaggccaauaacgaaaccauggcccucgagccggucgcuggagccagcaucgcugcgccccugacaggccagaauaacauuaucgacccuuggauuagacuuaauuucguucaagcccccaacggggaauuuacgguguccccucgcaauucucccggagaggugcugcucaaccuggaacuuggcccugagcugaauccguaccucgcccaccugagccggauguauaacggguacgcuggaggcgucgaggugcagguucugcucgccggcaaugcuuucaccgccgggaaacugguguuugcggccgugcccccucauuucccccuugaaaacaucuccccuggacagauuacaauguuuccccacgugaucaucgauguuagaacccuggagccggugcuccugccucuucccgacguccggaauaacuucuuucauuauaaucagcaaaacgaaccucgcaugagacugguggcuaugcucuacacaccccugcggucuaacggcagcggggaugacguguucaccgucuccugccgcguucugacaagacccagcccugauuuugacuucaauuaucucgugccgcccaccguggagucuaagacgaaaccuuuuacccugcccacacuuaccauuggagagcugacaaacucccgguucccuguccccaucgaugaacucuacaccagcccgaaugagucucuggugguucagccucagaacggccgcugugcccuugacggggaacugagaggaacgacacagcuccugcccaccgcuauuugcccuuuucggggccgcaucaaucaaaagguguccggcgagaaccacgucuggaauaugcaggucacaaacauuaaugggacccccuucgauccuaccgaagacguucccgccccgcugggaacaccugauuucagcggcaaacucuuuggggugcugucucagagagaccaugacaacgccugucggucccacgaugcugucaucgcgacgaauagcgccaaguucacccccaaacuuggagcuauucagaucggcacaugggaggaggacgaugugcacaucaaccaacccaccaaguuuacaccugucgggcuguucgaaaaugagggauuuaaccaguggacccucccgaauuauuccggcgcccugacgcuuaacaugggccuggcucccccuguggcccccacauucccuggggaacgcauucucuuuuucagaucucauaucccccugaagggaggcguugccgacccugugauugauugccugcuccaccaggaguggauccaacaucuguaccaggaaagcgcgcccucccagagcgacgucgcucuuauucgguuuaccaacccggauaccgggagagugcuguucgaggccaaacuccaccgcucuggauacaucacaguugccaauaccggcucccggccuaucgugguccccgcuaacggguauuuuagauucgacagcugggugaaucaguuuuacucucuggccccuaugggcacaggaaacggccgccggagagugcaauga

SEQ ID NO: 30488 - RNA, 1608 nt, Artificial Sequence
  derived and/or modified sequence opt5 from VP1__Norovirus_and/or_Norovirus-like__AF414418
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagagauucuucugaaucucgaacugggcccugggcuuaacccguuccuggcgcaccucucucgcauguacaauggauaugccggcggcguggagguucaggugcugcuggcugggaacgccuuuaccgcuggaaagcucgucuucgccgcgauucccccucauuuucccaucgagaaucugagcccuggccagaucacaauguucccccacgugaucauugauguuagaacccuugaaccggugcugcucccucugcccgacguccggaacaacuuuuuccauuacaaucaggagccugaaccccgcaugagacuuguggccaugcuguauacaccccuccgguccaacgggucuggagaugacguguuuaccgucagcugccgcguucugacaagaccuuccccggauuucgacuuuaauuaccuggugcccccuaccguggagagcaagacgaagcccuucacccucccuauccugacaauuggcgagcuuucuaacucccgguuucccgcuccgaucgaugaacuguauaccagcccuaaugaggggcucgucgugcaaccccagaacggacgcucuacacuggacggcgaacuucugggcaccacgcagcucguuccuuccaauauuuguagccugagagggcggaucaacgcccaccugucugauaaucagcaucgcuggaacaugcaagugacaaaugcuaacggaacccccuucgacccuacagaggauguccccgccccgcucggcaccccugacuuccuggccaauauuuacggggugaccucccagagaaaccccgacaauacaugccgggcucacgauggaauccuugcgacguggagccccaaguuuaccccuaaacugggcuccguugugcucgggacaugggaagaccgcgauuucgacaucaaccagccgaccagauuuacacccgucggacuguaugauaccgaccacuucaaucagugggcccuuccuaacuacucuggcgcucugacgcucaacaugaaucuggcccccagcguggccccucuguuucccggcgagcaacuccuguucuuucggucccauauuccucuuaaagggggaacaagcaacggcgcuaucgauugucugcucccccaggaguggguccagcacuucuaccaagaaucugccccguccagcaccgacguggcgcugauuagauauaccaauccugauacagggcgcguucuguuugaggcuaaacuucaucggcagggauucaucaccguggccaacucuggcagcagacccauugucgugccucccaauggguacuuucgcuucgacuccuggguuaaccaguuuuauucucucgccccgaugggcacaggaaauggccggagacgcgugcaguga

SEQ ID NO: 30489 - RNA, 1608 nt, Artificial Sequence
  derived and/or modified sequence opt5 from VP1__Norovirus_and/or_Norovirus-like__AF425769
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagagauucuucugaaucucgaacugggcccugagcuuaacccguuccuggcgcaccucucucgcauguacaauggguaugccggaggcguggagguucaggugcugcuggcuggcaacgccuuuaccgcugggaaacucgucuucgccgcgauucccccucauuuucccaucgaaaaucugagcccuggacagaucacaauguucccccacgugaucauugauguuagaacccuugagccggugcugcucccucugcccgacguccggaacaacuuuuuccauuacaaucaggaaccugagccccgcaugagacuuguggccaugcuguauacaccccuccgguccaacggcucuggggaugacguguuuaccgucagcugccgcguucugacaagaccuuccccggauuucgacuuuaauuaccuggugcccccuaccguggagagcaagacgaaacccuucacccucccuauccugacaauuggagaacuuucuaacucccgguuucccgcuccgaucgaugagcuguauaccagcccuaaugaaggccucgucgugcaaccccagaacgggcgcucuacacuggacggagagcuucugggcaccacgcagcucguuccuuccaauauuuguagccugagaggccggaucaacgcccaccugucugauaaucagcaucgcuggaacaugcaagugacaaaugucaacgggacccccuucgacccuacagaagaugugcccgcuccgcucggaaccccugacuuccuggccaauauuuacggcguuaccucccagagaaaccccgacaauacaugccgggcccacgaugggauccuugcuacguggagccccaaguuuaccccuaaacugggauccgugguccucggcacaugggaggaccgcgauuucgacaucaaccagccgaccagauuuacacccguggggcuguaugauaccgaccacuucaaucagugggcgcuuccuaacuacucuggagcccugacgcucaacaugaaucuggcucccagcgucgccccucuguuucccggcgagcaacuccuguucuuucggucccauauuccucuuaagggcgggacaagcaacggagccaucgauugucugcucccccaggaaugggugcagcacuucuaccaagagucugcuccguccagcaccgacguugcccugauuagauauaccaauccugauacaggccgcgugcuguuugaagcggagcuucaucggcagggguucaucaccgucgcuaaccccggaucuagaccuauugugguucccccgaauggcuacuuucgcuucgacagcugggugaaccaguuuuauucccucgccccuauggggacaggcaauggacggagacgcguccaguga

SEQ ID NO: 30490 - RNA, 1608 nt, Artificial Sequence
  derived and/or modified sequence opt5 from VP1__Norovirus_and/or_Norovirus-like__AF414421
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagagauucuucugaaucucgaacugggcccugagcuuaacccguuccuggcgcaccucucucgcauguacaauggguaugccggaggcguggagguucaggugcugcuggcuggcaacgccuuuaccgcugggaagcucgucuucgccgcgauucccccucauuuucccaucgaaaaucugagcccuggacagaucacaauguucccccacgugaucauugauguuagaacccuugagccggugcugcucccucugcccgacguccggaacaacuuuuuccauuacaaucaggaaccugagccccgcaugagacuuguggccaugcuguauacaccccuccgguccaacggcucuggggaugacguguuuaccgucagcugccgcguucugacaagaccuuccccggauuucgacuuuaauuaccuggugcccccuaccguggagagcaagacgaaacccuucacccucccuauccugacaauuggagaacuuucuaacucccgguuucccgcuccgaucgaugagcuguauaccagcccuaaugaaggccucgucgugcaaccccagaacgggcgcccuacacuggacggagagcuucugggcaccacgcagcucguucccucuaauauuuguucccugagaggccggaucaacgcccaccugagcgauaaucagcaucgcuggaacaugcaagugacaaaugcuaacgggaccccuuucgaccccacagaagaugccccggccccucucggaacccccgacuuccuggcuaauauuuacggcgucaccucucagagaaaccccgacaauacaugccgggcgcacgaugggauccuugccacgugguccccuaaguuuaccccgaaacugggaagcgugguucucggcacaugggaggaccgcgauuucgacaucaaccagcccaccagauuuacaccuguggggcuguaugauaccgaccacuucaaucagugggcccuucccaacuacuccggagcucugacgcucaacaugaaucuggccccuucugucgcuccccuguuuccuggcgagcaacuccuguucuuucggagccauauuccccuuaagggcgggacauccaacggagccaucgauugucugcucccgcaggaaugggugcagcacuucuaccaagagagcgcgccuucuuccaccgacgucgcucugauuagauauaccaaucccgauacaggccgcgugcuguuugaagccaaacuucaucggcagggguucaucaccguugccaacagcggaucuagaccuauuguggugcccccgaauggcuacuuucgcuucgacagcugggucaaccaguuuuauucccucgcuccuauggggacaggcaauggacggagacgcguucaguga

SEQ ID NO: 30491 - RNA, 1608 nt, Artificial Sequence
  derived and/or modified sequence opt5 from VP1__Norovirus_and/or_Norovirus-like__AF414416
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagagauucuucugaaucucgaacugggcccugagcuuaacccguuccuggcgcaccucucucgcauguacaauggguaugccggaggcguggagguucaggugcugcuggcuggcaacgccuuuaccgcugggaagcucgucuucgccgcgauucccccucauuuucccaucggaaaucugagcccuggccagaucgccauguucccccacgugaucauugauguuagaacacuugaaccggugcugcucccucugcccgacguccggaacaacuuuuuccauuacaaucaggagccugaaccccgcaugagacuuguggcuaugcuguauacaccccuccgguccaacgggucuggagaugacguguuuaccgucagcugccgcguucugaccagaccuuccccggauuucgacuuuaauuaccuggugcccccuacaguggagagcaagaccaagcccuucacgcucccuauccugaccauuggcgagcuuucuaacucccgguuucccgucccgaucgaugaacuguauacaagcccuaaugaggggcucgugguucaaccccagaacggacgcucuacccuggacggcgaacuucugggcacaacccagcucgugccuuccaauauuuguagccugagagggcggaucaacgcccaccugucugauaaucagcaucgcuggaacaugcaagucacgaaugcuaacggaacacccuucgacccuaccgaggaugugcccgccccgcucggcacaccugacuuccuggccaauauuuacgggguuaccucccagagaaaccccgacaauaccugccgggcucacgauggaauccuugcgacauggagccccaaguuuacgccuaaacugggcuccgugguccucgggaccugggaagaccgcgauuucgacaucaaccagccgacaagauuuacccccgugggacuguaugauacagaccacuucaaucaguggguccuuccuuacuacucuggcgcccugacccucaacaugaaccuggcucccagcguggccccucuguuucccggcgagcaacuccuguucuuucggucccauguuccucuuaaagggggaacgagcaauggcgccauugauugucugcucccccaggagugggugcagcacuucuaucaagaaucugcuccguccagcacagacgucgcccugaucagauacaccaacccugauaccgggcgcgugcuguuugaggcgaaacuucaucggcagggauucauuacaguugcuaauucuggcagcagacccaucguggucccucccaacggguauuuucgcuucgacuccugggugaaucaguuuuacucucucgccccgaugggcaccggaaacggccggagacgcgugcaguga

SEQ ID NO: 30492 - RNA, 1608 nt, Artificial Sequence
  derived and/or modified sequence opt5 from VP1__Norovirus_and/or_Norovirus-like__AF414419
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagagauucuucugaaucucgaacugggcccugagcuuaacccguuccuggcgcaccucucucgcauguacaauggguaugccggaggcguggagguucaggugcugcuggcuggcaacgccuuuaccgcugggaaacucgucuucgccgcgauucccccucauuuucccaucgaaaaucugagcccuggacagaucacaauguucccccacgugaucauugauguuagaacccuugagccggugcugcucccucugcccgacguccggaacaacuuuuuccauuacaaucaggaaccugagccccgcaugagacuuguggccaugcuguauacaccccuccgguccaacggcucuggggaugacguguuuaccgucagcugccgcguucugacaagaccuuccccggauuucgacuuuaauuaccuggugcccccuaccguggagagcaagacgaaacccuucacccuccugauccuuacaauuggagaacugucuaacucccgguuuccugcucccaucgaugagcucuauaccagcccgaaugaaggccuggucgugcaaccucagaacgggcgcucuacacuugacggagagcugcucggcaccacgcagcugguucccuccaauauuuguagccugagaggccggaucaacgcccaccucucugauaaucagcaucgcuggaacaugcaagugacaaaugcuaacgggaccccuuucgaccccacagaagaugucccugcuccccugggaaccccggacuuccuugccaauauuuacggcgugaccucccagagaaacccugacaauacaugccgggcccacgaugggauccuggcgacguggagccccaaguuuacccccaaacucggauccguugugcugggcacaugggaggaccgcgauuucgacaucaaccagccugccagauuuaccccggucgggcuuuaugauacagaccacuucaaucagugggcucugcccaacuacucuggagcccucacccugaacaugaaucuggccccuagcguggcuccccucuuuccuggcgagcaacugcuuuucuuucggucccauauuccccugaagggcgggacgagcaacggagccaucgauugucuccugccucaggaauggguccagcacuucuaccaagagucugcgcccuccagcacagacguggcucugauuagauauaccaauccggauaccggccgcguucuuuuugaagccaagcuccaucggcagggguucaucacaguggccaacucuggaagcagaccuauugucgugcccccuaauggcuacuuucgcuucgacuccuggguuaaccaguuuuauucucuggcucccauggggaccggcaauggacggagacgcgugcaguga

SEQ ID NO: 30493 - RNA, 1608 nt, Artificial Sequence
  derived and/or modified sequence opt5 from VP1__Norovirus_and/or_Norovirus-like__AF425767
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagagauucuucugaaucucgaacugggcccugagcuuaacccguuccuggcgcaccucucucgcauguacaauggguaugccggaggcguggagguucaggugcugcuggcuggcaacgccuuuaccgcugggaagcucgucuucgccgcgauucccccucauuuucccaucgaaaaucugagcccuggacagaucacaauguucccccacgugaucauugauguuagaacccuugagccggugcugcucccucugcccgacguccggaacaacuuuuuccauuacaaucaggauccugaaccccgcaugagacuuguggccaugcuguauacaccccuccgguccaacggcucuggggacgauguguuuaccgucagcugccgcguucugacaagaccuuccccggacuucgauuuuaauuaccuggugcccccuaccguggagagcaagacgaagcccuucacccucccuauccugacaauuggagagcuuucuaacucccgguuucccgcuccgaucgacgaacuguauaccagcccuaaugagggccucgucgugcaaccccagaacgggggaucuacacuggauggcgaacuucugggcaccacgcagcucguuccuuccaauauuuguagccugcgcgggagaaucaacgcccaccugucugacaaucagcaucgguggaacaugcaagugacaaaugucaacggaacccccuucgauccuacagaggacgugcccgcuccgcucggcaccccugacuuccuggccaauauuuacgggaucaccucccagcgcaaccccgauaauacaugcagagcccacgacggaauccuugcuacguggagccccaaguuuaccccuaaacugggcuccguugugcucgggacaugggaagaucgggacuucgauauuaaccagccgacccgcuuuacacccgucggacuguaugacaccgaucacuucaaucagugggcgcuuccuaacuacucuggcgcccugacgcucaacaugaaucuggcucccagcguggccccucuguuucccggcgagcaacuccuguucuuuagaucccauaucccucuuaaagggggaacaagcaacggcgccauugacugucugcucccccaggaguggguccagcacuucuaccaagaaucugcuccguccagcaccgauguggcccugauccgguauaccaauccugacacagggagaguucuguuugaggcgaaacuucaucgccagggauucauuaccguggcuaacucuggcagccggcccaucgucgugccucccaauggguacuuuagauucgauuccuggguuaaccaguuuuauucucucgccccgaugggcacaggaaauggccgccggagagugcaguga

SEQ ID NO: 30494 - RNA, 1608 nt, Artificial Sequence
  derived and/or modified sequence opt5 from VP1__Norovirus_and/or_Norovirus-like__DQ093065
augaagauggccagcaacgacgcugcccccuccaaugauggcgcggcugggcuggugccugaggucaacaaugaaaugauggcccucgagccgguugccggagcuucuaucgccgcuccccugaccggccagaacaaugugauugacccuuggaucagaaugaacuucgugcaagcccccaauggggaauuuacagucagcccucggaacucccccggagagauucuucugaaucucgaacugggcccugagcuuaacccguuccuggcgcaccucucucgcauguacaauggguaugccggaggcguggagguucaggugcugcuggcuggcaacgccuuuacggcugggaagcucgucuucgccgcgauucccccuagauuucccaucgaaaaucugagcccuggacagaucaccauguucccccaugugaucauugauguucggacacuugagccggugcugcucccucugcccgacguccgcaacaacuuuuuccacuacaaucaggaaccugagcccagaaugcggcuuguggccaugcuguauacaccccuccgcuccaacggcucuggggaugacguguuuaccgucagcugcagaguucugacccggccuuccccggauuucgacuuuaauuaccuggugcccccuacaguggagagcaagaccaaacccuucacgcucccuauccugaccauuggagaacuuucuaacucccgcuuucccgcuccgaucgaugagcuguauacaagcccuaaugaaggccucgucgugcaaccccagaacgggagaucuacccuggacggagagcuucugggcacaacccagcucguuccuuccaauauuuguagccugcggggccgcaucaacgcccaucugcccgauaaucagcacagauggaacaugcaagugacgaaugcuaacgggacaccuuucgaccccaccgaagaugucccggccccucucggaacacccgacuuccuggccaauauuuacggcgugaccucucagcggaaccccgacaauaccugccgcgcucaugaugggauccuugcgacaugguccccuaaguuuacgccgaaacugggaagcguugugcucggcaccugggaggacagagauuucgacaucaaccagcccacacgguuuaccccugucgggcuguaugauacagaccacuucaaucagugggcccuucccaacuacuccggagcucugacccucaacaugaaucuggccccuucuguggcuccccuguuuccuggcgagcaacuccuguucuuuagaagccacauuccccuuaagggcgggacguccaacggagccaucgauugucugcucccgcaggaauggguccagcauuucuaccaagagagcgccccuucuuccacagacguggcgcugauucgcuauaccaaucccgauaccggccggguucuguuugaagcuaaacuucacagacagggguucaucacaguggccaacagcggaucucgcccuauugucgugcccccgaauggcuacuuucgguucgacagcuggguuaaccaguuuuauucccucgccccuauggggaccggcaauggaagacgccgggugcaguga

SEQ ID NO: 30495 - RNA, 1608 nt, Artificial Sequence
  derived and/or modified sequence opt5 from VP1__Norovirus_and/or_Norovirus-like__KJ194507
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagaggugcuucugaaucucgaacugggcccugagcuuaacccguuccuggcgcaccucucucgcauguacaauggguaugccggaggcguugaggugcagguccugcuggcuggcaacgccuuuaccgcugggaaacucguguucgccgcgauucccccucauuuuccccuggaaaaucuuagcccuggacagaucacaauguucccccacguuauuaucgaugugagaacccuggagccgguccuccugccucuucccgacgugcggaacaacuuuuuccauuacaaucagcaaccugaaccccgcaugagacugguggccaugcucuauacaccccugcgguccaacggcucuggggaugacgucuuuaccguuagcugccgcgugcugacaagaccuuccccggauuucgacuuuaauuaccucgugcccccuaccgucgagagcaagacgaaacccuucacccugccuauccuuacaauuggagagcugucuaacucccgguuucccgugccgaucgaugaacucuauaccagcccuaaugagggcguugugguccagccccagaacgggcgcucuacacuggacggagaacuucugggcaccacgcagcucgugccuuccaauauuugugcucugagaggccggaucaacgcccaaguucccgaugaccaccaucaguggaaucuccaggugacaaacaccaaugggacaccuuucgaucccaccgaggacgucccggcuccucugggaacccccgacuuccuggccaacauuuacggcgugacaagccagcgcaaucccaacaauacgugcagagcccacgaugggguccuugcuaccuggucuccuaaguuuacaccgaaacugggauccgugguucucggcaccugggaagagagcgaccuggaucuuaaccaacccacacgguucaccccuguggggcuguuuaauacggaccacuucgaucaguggguccuccccaacuauuccggacgccugacacugaacaugaaucucgcgccuucugugagcccccuguuuccuggcgagcagauccuuuucuuuagaucccauauuccccugaagggcgggaccagcgacggagccaucgauugucuccugccgcaagaauggauccagcacuucuaccaggagucugcuccuucccccaccgacguugcccugauucgguacacaaacccugauaccggcagagugcuuuuugaagccaagcuccaucgccagggguucaucacagucgcuaauagcggaucucggcccauuguggugccgccuaacggcuauuuuagauucgacagcuggguuaaucaauuuuacucccuggcccccauggggacgggcaacggacgccggagaguccaguga

SEQ ID NO: 30496 - RNA, 1608 nt, Artificial Sequence
  derived and/or modified sequence opt5 from VP1__Norovirus_and/or_Norovirus-like__KP064099
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccugucucgcauguauaauggguacgccggaggcguugaggugcagguccugcucgcuggcaacgccuucaccgcugggaaacugguguuugccgcgguucccccucauuucccccuugaaaauauuagcccuggacagaucacaauguuuccccacgugauuaucgaugucagaacccuggagccggugcuccugccucuucccgacgugcggaacaauuucuuucauuauaaccagcaaaacgaaccucgcaugagacuggucgccaugcucuacacaccccugcgguccaauggcucuggggaugacguuuucaccgugagcugccgcgugcugacaagacccuccccugauuuugacuucaacuaucucgucccgcccaccguggagagcaagacgaaaccuuuuacccugcccauccuuacaauuggagagcugaccaauucucgguucccuguucccaucgaugaacucuacacauccccgaacgagagccuggugguccagccucagaauggccgcugugcucuugacggggaacugcagggaaccacgcaacuccugcccacagccauuugcucuuuuagaggccggaucaaccagaagguguccggcgauaaucacguuuggaacaugcaagugaccaauauuaacgggacaccuuucgaccccaccgaggaugucccugcuccccugggaaccccggacuucagcggcaaacucuuuggggugcugucucagcgcgaccaugauaaugccuguagaucccacgacgccgucaucgcuacagauagcgcgaaguucacgccuaaacuuggagccauucagaucggcaccugggaagaggacgaugugcacaucaaccagcccacaaaguuuacccccguugggcuguucgagcgggaaggauuuaaucaguggacacucccuaacuauuccggcgcucugacccuuaauaugggccuggccccgcccguggccccuacguuccccggggagcaaauucucuuuuuccgcucucauaucccucugaagggaggcgucgcugaccccgugauugauugccugcucccucaggaauggauccagcaccuguaccaggagagcgcccccucccaaacagacguugcgcuuauuagauuuaccaacccggauaccgggcgggugcuguucgaagcuaaacuccauagaagcggauacaucacagucgccaacaccggcucucgcccuaucguggugcccgccaauggguauuuucgguucgacuccuggguuaaccaguuuuacagccuggcuccuaugggcacaggaaauggcagacgccggguccaguga

SEQ ID NO: 30497 - RNA, 1608 nt, Artificial Sequence
  derived and/or modified sequence opt5 from VP1__Norovirus_and/or_Norovirus-like__AB303926
augaagauggccagcaacgacgcuacccccuccgauggcucuacagccaaucuggugccugaggucaacaaugaaguuauggcgcucgagccgguggugggggcugccaucgccgcuagagucgccggacagcaaaacgugauugaccccuggauccggaauaacuucguucaggcuccuggcggggaauuuacggugagcccccgcaaugccccuggagagauucugugguccgcgccccuuggcccugaucugaacccguaccucucucaccuggccagaauguauaauggguacgcuggaggcuucgaaguccaggugauccuugccggcaacgcuuuuaccgccgggaaaauuaucuucgcggccguucccccuaauuuucccacagagggacugagcccuucccaggugaccauguucccccauaucauugucgacgugcggcaacucgagccggugcugaucccucugcccgauguccgcaacaauuuuuaucacuacaaccagucuaaugacagcacaauuaagcucaucgcuaugcuguauaccccucuuagagccaacaacgcuggcgaugacguuuucacaguguccugccgggugcugacccgccccagccccgauuuugacuucauuuuucucgucccuccgacgguggaaucuagaaccaaacccuucacaguuccuauccugaccguggaggaaauguccaauagccgguuucccgucccucuugagaagcuguacacagggcccucuuccgccuucgugguucagccgcagaacggacgcuguaccacggauggcgugcuccuggggacaacccaacugagcgccgucaauauuugcacauucagaggagacgugacccauaucgcuggcucucacgauuauaccaugaaccucgcgucccagaauuggaacaauuacgacccuacagaggaaauccccgccccucugggcacgcccgacuuugucgggaaaauucagggagugcuuacccagacaacccgggaggauggcagcacacgcgcucauaaggccaccguuuccacggggucugugcacuucacaccuaagcugggaagcguccaauacaccaccgacacaaacaaugauuuucagaccggccagaacacaaaauucacgcccguggggguuauccaagacggauccaaucaccagaacgaaccgcagcagugggugcucccuaauuauagcggcagaaccggccauaacguccaccuggcccccgcuguggcccccacauuuccuggggagcaacuucuguucuuucggucuaccaugccgggauguuccggcuaccccaauaugaaccucgauugccugcugccucaggaaugggugcagcauuucuaucaggaggcggcucccgcccaaagcgacguugcccuccugcgcuuugucaacccugauacagggagagugcuuuucgaguguaagcugcacaaaucuggauacgugaccgucgcucacacgggcccccaugaccucgugauuccucccaauggguauuuucgguucgauagcuggguuaaccaguuuuacacccuggccccgaugggcaauggagcuggcagauga

SEQ ID NO: 30498 - RNA, 1608 nt, Artificial Sequence
  derived and/or modified sequence opt5 from VP1__Norovirus_and/or_Norovirus-like__KU985166
augaagauggccagcuccgacgcuaaccccucugauggcagcaccgccucccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgacagcaccauuaagcucaucgcuaugcuguauacaccccuucgcgccaauaacgcuggcgaugacguuuucaccgugucuugcagagugcugacacggcccuccccugauuuugacuucauuuuucucgucccgcccaccguggaaagccgcacgaaaccuuucucuguucccauccugaccguggaggaaaugacaaacuccagauuuccuauuccccuugagaagcuguucaccgggccgagcucuacauucgucgugcagccucagaauggacgguguaccacggauggcguucuccuggggacaacccaacugucccccgugaacaucugcacauuucgcggaggcaucaccagaauuggccagagcgaguccuacaaaaugaaucucgccucucagaacuggaauaacuaugacccuaccgaagagauccccgccccucuggggacacccgauuucaagggacggauucgcggccuucugacgcagaccacaaagggggcuggaagcaccagaggccauaaagcgacaguccucaccgggggauccgacuuuacgccgaagcugggcacagugcgguucgacaccaaaagcaucgauuuugaaaauaaccaaaauaccaaguucacaccugucggcgugguucaggacgggaacaaucacgaugagcccacccagugggugcuucccaacuacucuggaccugacacacauaauguccaccuggccccggcuguggcccccacguuuccuggcgaacaacuccuguucuuucgcuccaccaugcccggguguagcggauacccuaaaauggagcuggauugccuccugccccaggaguggguucagcacuucuaucaggaagccgcuccugcccaaacagacguggcgcuucugagauuugucaaccccgauaccggccggguucucuucgaguguaagcugcauaagucuggguacgugacaguggcucacaccggcgaccaugaucuugucauuccgccuaauggauauuuuagauucgacagcugggugaaccaguucuacacgcuggcccccaugggcaacgggaccggacgccggagauga

SEQ ID NO: 30499 - RNA, 1608 nt, Artificial Sequence
  derived and/or modified sequence opt5 from VP1__Norovirus_and/or_Norovirus-like__JN699045
augaugauggccagcaaggacgcucccaccuccccugauggcgccucuggggcgggacagcuggugccggaagcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguuccauaauuccucucagccgcaaccuacgaugcgccucguggccaugcuguauacaccccuuagaaccggcgggggaagcggcgggaccgaugcuuuugucguggccggacgggugcugacaugcccugcccccgacuucuccuuucucuuccuggugcccccuagcguugagcagaagacccgcguguuuucugugccgaacgucccccugaaagaucucuccaauagcagagugccuguucccauucagggcauguucaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggacaccguuuaucccucuugaaucucccgcgccugucggauuccccgaccugggcgggugugauuggcacgugaauuuuaccuuccaggcccaaaaccaggacccuagccaguccgucaccuuugcuacaaaugaugccagcuucgugcccuaccucggaucuaucuccccgcauaacggcggcgacuuucacagcggggauauuaucggaucucugggcuggauuagcgccccuuccgacucuagccagcugaauguuuggacgauccccaaguauggguccagccuccccgaugugacccaccuggcuccugccgucuucccgcccggauuuggcgaggugauucuuuacuuccauucuacauuuccuggguccggccaacccggacagcugcagguuccuugccuccugccccaggaguucaucacccacuuuuguaacgaacaagcgccuaucgcuggcgaggccgcccuucugcauuauguggaccccgauacagggcggaaucucggagaguucaagcuguacccggacggcuucaugaccugcgucccuaacagcgugucuuccgggccccagacgcugccuauuaauggaguguuuguuuucgucagcugggugucccgcuuuuaucagcucaaacccgugggcacagcuucugccgcuagacggcuguga

SEQ ID NO: 30500 - RNA, 1608 nt, Artificial Sequence
  derived and/or modified sequence opt5 from VP1__Norovirus_and/or_Norovirus-like__EF547395
augaugauggccagcaaggacgcucccaccuccccugauggcgccucuggggcgggacagcuggugccggaagcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguuccauaauuccucucagccgcaaccuacgaugcgccucguggccaugcuguauacaccccuuagaaccggcgggggaagcggcgggaccgaugcuuuugucguggccggacgggugcugacaugcccugcccccgacuucuccuuucucuuccuggugcccccuagcguugagcagaagacccgcguguuuucugugccgaacgucccccugaaagaucucuccaauagcagagugccuguucccauucagggcauguucaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggucuccguuuaucccucuugaaagccccgcgccugucggauuccccgaccugggcgggugugauuggcacgugaauuuuacauuccaggcccaagaccaggauccuucccagagcgucaccuuugcuaccaacgacgccucuuucgugcccuaccucggauccaucagcccgcauaauggcggcgauuuucacucuggggacauuaucggaagccugggcuggauuuccgccccuucugauagcucccagcugaacguuuggacaauccccaaguaugggagcucucuccccgacgugacgcaccuggcuccugccgucuucccgcccggauuuggcgaggugauucuuuacuucuauuccaccuuuccugggagcggccaacccggacagcugcagguuccuugccuccugccccaggaguucaucacacauuuuuguaaugaacaagcgccuaucgcuggcgaggccgcccuucugcacuacguggaucccgacaccgggcggaaccucggagaguucaagcuguauccggauggcuucaugacaugcgucccuaauucuguguccagcgggccccagacccugccuauuaacggaguguuuguuuucgucuccugggugucucgcuuuuaccagcucaaacccgugggcacggcuagcgucgccagacggcuguga

SEQ ID NO: 30501 - RNA, 1608 nt, Artificial Sequence
  derived and/or modified sequence opt5 from VP1__Norovirus_and/or_Norovirus-like__AY502008
augaugauggccagcaaggacgcucccaccuccccugauggcgccucuggggcgggacagcuggugccggaagcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguuccauaauuccucucagccgcaaccuacgaugcgccucguggccaugcuguauacaccccuuagaaccggcgggggaagcggcgggaccgaugcuuuugucguggccggacgggugcugacaugcccugcccccgacuucuccuuucucuuccuggugcccccuagcguugagcagaagacccgcguguuuucugugccgaacgucccccugaaagaucucuccaauagcagagugccuguucccauucagggcauguucaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggucuccguuuaucccucuugaaagccccgcgccugucggauuccccgaccugggcgggugugauuggcacgugaauuuuacauuccaggcccaagaccaggauccuucccagagcgucaccuuugcuaccaacgacgccucuuucgugcccuaccucggauccaucagcccgcauaauggcggcgauuuucacucuggggacauuaucggaagccugggcuggauuuccgccccuucugauagcucccagcugaacguuuggacaauccccaaguaugggagcucucuccccgacgugacgcaccuggcuccugccgucuucccgcccggauuuggcgaggugauucuuuacuucuauuccaccuuuccugggagcggccaacccguucagcuccaggugccuugccugcugccccaggaguucaucacacauuuuuguaaugaacaagcgccuaucgcuggagaggccgcccuucugcacuacgucgaucccgacaccggccggaaccucggggaguucaagcuguauccggauggauucaugacaugcgugccuaauucuguguccagcggcccccagacccugccuauuaacgggguuuuugucuucguguccugggugucucgcuuuuaccagcucaaacccgucggaacggcuagcguggccagacggcuguga

SEQ ID NO: 30502 - RNA, 1608 nt, Artificial Sequence
  derived and/or modified sequence opt5 from VP1__Norovirus_and/or_Norovirus-like__AY502007
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucgugccucuugaaucucccgcgccugucggauuucccgaccugggcgggugugauuggcacgugaauuucaccuuucaggcccaaaaccaggacccuagccaguccgucaccuucgcuacaaaugaugccagcuuugugcccuaucucggaucuaucuccccgcauaacggcggcgacuuccacgccggggauauuaucggaagccugggcuggauuucugcuccuagcgacaauacgcagcugaacguuuggaccauccccaaguacggguccucucuccccgaugugacacaccuggccccugcggucuuuccgcccggauucggcgaggugauucuuuauuuuuacagcaccuucccuggguccggccaacccagccagcugcagguuccuugccuccugccccaggaauuuaucacacauuucuguaaugagcaagcuccuaucgccggagaggccgcccuucugcacuauguggaccccgauaccggccggaaccucggggaauuuaagcuguacccggacggauucaugacgugcgucccuaauucuguguccagcggcccccagacacugccuauuaacgggguguucguuuuugucucuugggugucccgcuucuaccagcucaaacccgugggaaccgcuagcgcugccagacggcuguga

SEQ ID NO: 30503 - RNA, 1608 nt, Artificial Sequence
  derived and/or modified sequence opt5 from VP1__Norovirus_and/or_Norovirus-like__KC998959
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccguucagggcauguuuaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggacaccguucaucccucuugaaucucccgcgccugucggauuucccgaccugggcgggugugauuggcacgugaauuucaccuuucaggcccaagaccaggauccuagccaguccgucaccuucgcuacaaacgacgccagcuuugugcccuaucucggaucuaucuccccgcauaauggcggcgauuuccacgccggggacauuaucggaagccugggcuggauuucugcuccuagcgggaacucccagcugaauguuugggccauccccaaguacggaucuagccuccccgaugugacgcaccuggcgccugcugucuuuccgcccggcuucggggaggugauucuuuauuuuuacuccaccuucccuggcagcggacaacccucucagcugcagguuccuugccuccugccccaggaauuuaucacacauuucuguaacgagcaagccccuaucgccggcgaggcugcccuucugcacuauguggaccccgauaccgggcggaaucucggagaauuuaagcuguacccggacggcuucaugacaugcgucccuaacuccgugagcucugggccccagacccugccuauuaauggaguguucguuuuugucuccugggugagccgcuucuaccagcucaaacccgugggcacggcuuccgccgcgagacggcuguga
